United States Patent 11,872,256 (BACTERIOPHAGE COMPOSITION AND METHOD OF PREVENTING BACTERIAL INFECTIONS IN LIVESTOCK) - sequence listing, part 2

SEQ ID NO: 19 - DNA, 72689 bp, Unknown
  Podoviridae; G7cvirus
tggctggggctacacccttacactcaactagcccccccggtatgttgacggtgtagccactaccctaccccaccttacacgttacacatgctccgcatgttatggacatgtcgtcctatcatcaactattggagctatcatcatgactactaccgctactgtacgtatgaccgcaggaactttacttggtactgttaactcagctgctactactgttgcagatacatttggtacagcaactaaagcagtaggtatgcttaattcatatgtaagtactatggcagagaaacaagccatccgtactaaattagaaatgcatacctttgttaataaactggcagaggagacagctatgactgagactctgcgtaagaaaagtattgaagaattctgcaaggataaagagaacgctcggatctataacgcagaatattcaaaagtaatcgacatcctgactaaaagctaagtcacataggaggctcttcggagtctcctgttttgaacattagatagatagtcaaaagtagataaatatctactttaggagaaataaaatgtccctgacagattgcaaatctgaatctccgcaggaagcattagaacgttttgaagaagccgttcgtcagcaagagcaatatcagtctgacatccatcattatggagaatcagacatagatatctcagacgaaactgtagaaagtaagtatcagaaagctaaggctgaattactaacctggttgtcctacattccgtaaaaaccaagacgctccgcgtcttatggatgatgtaaatgcatccactaatcattgaacttttatccttttgtttgggtgttctcaccgacgagttcacccgtaaatcacataaatctggagagtacaaaatgtctattcaaaaattcactttcggtcaatctaacaatgctgctacttctactactaaaactgataagcctaaagctcagttctggctgaacattggctatgtagctaacgaaggttctgatgatgagaaattcatctcattgcctactggtattccgctggatactcaggaaccgctgcctactaatagcagcaatgctgacttccgtgctatgcgttgtgcacagaacgacttgctggaacagttaatcgaatatgctcagaacctggaaccaggtgaagaaggtatcattaacctgcaagttcaacttcgtcgtgtgaaagcagaggctgctgacatcccagcagacgagaataaatatgctcgtaaactgactttctaatcaaccactagactcccttcggggagtcttttatttttaactagacgataatctatttctactttttgagtatctttagacgaagggtactgaaacagtaaccagatagatatagatttatattagatgaaggagtaaccattatgcgtacagtatgtaaccgttataactcacaaaagttgattgttatgttacaaccttggggtagtaagatgtctcttaatgctcgttggcaggtatctgtagaagataagaatggtcagcattatgaccacttctttgtagctaaacctactcgtaaacaaatccgtaaacttcataaggtgtaagactatgttggacttcattgcgtttgtaatactctgttatgtgctgtatcgcctacgtggttacattctcaatggagccaagtgggtaagaactaagctggtacttatctgtaagttacctgttgtattcgttaagtgtctgtttgcttccatcgtagctaaagaggtacgcaagcaactatgggctaaagaagcagaagagtttgcaaagaggaaccagtgatattcactaacatagaagatgccattgaagagtgtatctttcgtagatatcacactggtgtacagaaacgacactatggtgttgtgcaactcaatggctatcaaatggttgtaagaattgtacgtaacagcaaaccttttaactttatgtggagtactaaacatgcgtaagtcattaatcatgggaaccaaagctgacgtacagagaatgaaggaacgtctggctgctaagcaacagacatctgaaccagtacgtaagattgttactttcaatcataggtgtatcaaataataaggagtcctccaataggaggctcctattttttatttttgaatagttagatatgtatttaaataggagaaataaccttgaatgaaatagtatgtatacttcctcaccaagctaaagtagctgacaggaatatacgggtacatttaccattcccattaagtaatccatttgctcgtaacgaaagaaccacggtagaagatatagaggtagcttatgaggcttaccttcgtaatcgtcttattaatggtgacaagttaattacagcagagatggaaaggattgctggctttgtaactgatagtacaggtaaacctgttggtttaattggtactgaatctgatgttaacgttattcgtaaaatactgatggaggcactcggtgaacaatcttagtgatgtcatcgtagataaaacaatattagtaaatcccaaagggtatgcctggttcatgctaaagcatacccgtaaggtatatgttagaaaggtatatatacgtaactttggtaagttatcttacagagaagtacgtattaataatgagatgtactttctagatgaatcagtgattatcaaatcaactgaagacagaaaggctccttactttaactattacggattcaactaaaatgatgtactcaactgattatggtgtttgccctgtatgtaacaaacgtaaaggagttgctaatcataagcgttgtagtcgtatattacagaaacaacggaaccagaaagaatgggataagctgttggaaaaccagcataaagaagaaaatcaacagatggctgttaaggcatctactcaacgtattcgtcgtattaactatatacaggggtatcagaaatgagactaatcgtagctggtggaagagacttcgtaaataccaatcttatgattgaggaattacagaagttagtaaattcagtaaatatacctgaatgcccagaattagtatgtggtatggctcgtggagcagatatgcttgcatataatctatgggctaataacaaaatgcctattcataatttcccagcaaactgggataaatatggaaagtctgctggttatagacgtaaccaggaaatgggtgaatttgcagatgctgctgtatgtttctgggatggtaattccaaaggaaccaagcacatgattgatatcatgtataggcttaataaacccgtatacgttgtgaggtactaaatgattattacatatcctacaggcaagactgtggaatatatgaagcacaccattcaagtacctcactgggttaagtatatagctttattaccacgtcaatataaaagtgctaatacctcattaataggattctctaagaagcctaagctaacagaaaacaatatctgggtatcctctgggagacaagaagaaattggtttttgtgatttgagtattgtcgataataacatctatgggacattgagaaaggtatgaaaactattctagtagttcatgattctacatttacagatgtagataaaatgatgcgtaatattgattatgtatctcaaacaagccaggcattcaatgaagaatttaccctctactgcaatgctgaatctccactggttcctatccttaaagaatcaggtctaccattctctacagagaacttcccggaagaaccagactatgtaatctcattcatttatgacttacatgatggttctgaaactagtgaactagctatgaaccagtggcgtagtaaacgtcctgtgttcgcattccaggtacttaagccatgatttataaagaatattatgtattcaaaaagggggatgattttatagctatgccggatgattatatagattggcatacaactcccgtattaaatgaagcattttctgtacctaacctagaagaggttaataaagtaatgaacggggtaatgttaacaagagggttagcttacaaaatagacgcattagaaggaactactgtatgtaaagtaagtacatctattgaggcattaaaaccatgaagactattacattaggggacgacaccaatgctttgctgggtgtagctgcacgtccaattatcattgttaataaacatcacggtaaatccggtgagtatatcggacgtggttcaccattaggaaatccattcgttattggtaaagacggttcaagagaacaggttatagccaaatatcgagtatggcttaatgaacaaatcatgaggaagaatcaagctgtattggatgaacttaatcgtcttggtaataaagccattgatgagaaagggttggccttacagtgcttctgttatccgaaaccatgtcatggtgaggttattaaagagaagctagtaaaagctatgtataactactttgtggagaatccaaaggggtaactaatgaaagaaatattcgtattcactaccaatacactaggacaacataccaatgcttctgccaagttagcttataagaaacatggtgctcgttggggcatggcctatggtcactatggtaatagctttgctattccagtaagagatggcaatggtaaccgtatcaaagagggtgctatctatggcttcattgagggctttattgcttatgcatctgccaatccacaatgggatttcaaagtcatgagtaatgactacctggacccataccagttcattaatgtaaccggaaatgtactgttacccgaagcatggcgtaaacacttaggcgatgcttacaactactggagttaataatgacttatgaagaactgtgggctgctcaagtcagagccagagcacttacacggcatgatatctattgtgcattacaaaacgaactaaaggatcgtactaaactaggtcacatatctggtttaattaaaatacctatgcgtagtctggtatggccttaccagaagaaaaataacgagtttagtggtaatggtttatatgtacgtattgactaccttggtcaagagaacagtattcgtattaccttttggactaaacgttaggtaatagctgctccgcagcttttggttattaatcacatttaggagaataagcgatgtactcatccattgaacatcagaagcaactcgaaattcttttcaacaaaaatcaattactccctcgcatgaggaaggaatttgaggactccgaagaaattgactttaaggcattcgctgcctatttggaaattgattataagctgctcattgatgcaatggtgcagattgccctacataaacgtgctgaccttcagactatgattggctctcttatgagccattcagatgatgctcagtacatcgctgactgtctgtataagatggcagagaatgactgcttcaactatgaccctaccatcgacaagttcggtgttatctacgagattagtgaagatgttcagatggaactggaagcattccagtatccattacctatcgtaagtgctcctaagcctgttctgtgtaaccgtgatacaggttactatgagagcaggggaagtattatcctcaagaagaaccatcatgagatggatgtctgtcttgatcacatcaaccgtatgaataatcaacgtctaagcattaactgggacgttgctaactatgtaaaagactctcgtcctaatatggataaacccaaagagggtgaaacccgtcaggaatatgagaaacgtgttaaagcctttgagaagtacagccgtactgctaaggaagtaatggagttagtgaccaaagaaggtaataacttctcactgggtcacaaatatgacaaacgtgggcgtacttacgctcagggctatcacatcaactatcagggaaccagttacaacaaagctgtactggaatttgctgataaggagttagtaaataatgattaatcatcgtgcagtaaaagacttctatgcccatagggaattggtactaaaacgtatcaatgaagcaatgaaacgtgaagctgaagctaaacgtaaccgtaaataaattcaaatgcgagccaagaggactaatcccaatgagtgagttattaaaactatggcttattagccagaatgagcgtaaggggtgggatacgttcgactctgctgtggtagcagctaaaaccgcagaagaggctcgtcttattaacccagatggagaatggagtacatactccgcttggtgttcttccccagataaagtgcacgtcgagtacctgggtattgccaccgaaggtgtggaaccaggaatagtattgtcatcatttaatgctggctaatacatccaataagcaggctctccatagtggggagccaagaagcaaaaggaacataaaatgcaactgttaaccgctcgtgaatacctgaaagtagatattgccaataactatggtctggataaaaagacctgggatgagcgtattgcttggttcgatgagaatgaagctaacttgcttaatctggtagatgaagctgaggaatctgcactgttctatgctggtgtaaacgcatggaaagatatgaaagctggtaagcctatcggatatgccgtagccctggatgctacatcatcaggcttgcagttactggcctgcctgactggtgaccgctctgctgctgaactgtgtaacgtagttaattacatgggagagaatggtaagccattacgacgtgatgcttatacagttatatatcacaagatgctggacatccttggtgaagcatcccgtattaaacgtagtgataccaagcaggcagttatgactgcattctacggttcagaagccaaacctaaagaagtattcggggaaggtatccgtctcaagacttttgaaaatgtaatggaaacagttgcaagtggtccttgggcacttaacaagttcttactgcaatgtggtaacccggatgctaaccgttacatatgggtactccctgacaacttccacgctgtcattaaagtcatggttcttgaagtacagactgttaacttcttgggtaaaccatttgacatcactcgtatggttcagggtactgaagagaagacccgtatgctctctgctaacatcactcactctattgatgggatggtagtacgtgagatgctgcgtcgttgtaacttcgaccctaaactggttgcctatgtacgggaactgtgcgatatcgggccaagtgaataccccgttattgaggggaaccaagagaagactatggaaatctggaatcattatgaaaggtcaggattcctgtcgctgtctatcctagacttccttgacccgaatactattgcactggtagaccgtcaagtagtagcagatatgatcgacactatgcctaagaaaccattccctgtaatgactgtacatgattgcttccgttgccaccctaactatggtaatgacctgcgtcgtcagtacaatcagattctgtctgacattgctaagagtgacttactgggcttcattctgtctcaagtactgggacaagagttctctgctggtaagctggatgacagcctctggcaagacattctagaaacagattatgcattaagttaataaactagcctcattccttcgggagtggggctttattttttgcttggaggtagcaactatgcttatcaattttgaagtaatctctcagctaatactgatagttttatctgtactggttctggctacgatagttcgtgcccacaagtctaagtttgcttactgctactatggagcatactcactaggatgctttgtaatggcaggatggatagcttttgctatctactgtgtaaacaactaaccctcttaacggagggtttatttttttacatgtcatgtatactaatcctgctatttacttatgaggaaattcatatgccaactttaaaagtaggttttaacaaaaccaccaatgtcgcaactgtactggatgcgagtggttctatcccgggtggttcagtagaagtaggtacttttgtacacccggatgccacttacccagatagtttagttatttttcatggtgttcgtgatctgctgtataaacgttctgctaaagacccatctgaagaaggcttctggcctaacaacatcgtagatatgcagtccatctctattgatatgcaagctactccacgactgactattgctactaagctgcctcgtgtagtctccgctatcgaaggcgaagatattaactggcatgttgatgtagcaggcggtaaagcaccatttacttataaatggcagttcaaagctgatactgctggtgcagcattcactgatattagctctagtactaacccatctgctgctactgcaacattaacccttaatgacgtaaccgctgcttctgctggtacttataaagtgattgttactgatgccaatggaaccactgtagaagataagtctctactggctgttggctactacgaagcaagctcactggtagctactcctgcttcattgtctctgtctgttgctgctgatgctacttctggtaagactgtaaccattactaatgtgcctattggttcatctgctggtactttgtctattaagactgccccagagtctggtcgtgctacggctaccattgctggtaacgtattgacggttaaacctgtagctgctggtgaagctacttctgtagtagttaccaacggtaaggtcgatgtaaccatcgctattactgttgtagaataaaggtagcctttatttggggttgtaaaccctgatataaaactcccaagcttgacctcccagatgaagggaggtctttttttgacttaaacattctggagccaggaaatgtataaagagattgcatttttctcattcttactaggcggtttattaggtgcaggatttgtagctatttctaatacctactttggttctactccaaattctgtaacacaaaccctcaagcatgaatgtgaattgaatatccctcgtaatcaaaactgtgtaatgcagttcgtaccggagaaaaaatgaatatccacaatctacgtttggttgagaaactgtacgaagaatacaacgacaaccgacagcaattagctagtttgaagaagtcaccacatatggtgaaagtatcattcaatggtacggatttaggaccgcaagctcgtacaagaatacttcctgaactgctgtcattttatcaaaagagaattgctgtcttagaaaaacgctttgagcatttatgtgtagatttatcaccactcccagatgaaggagaagatgagtgaaattaacccagtcccaagcaatcttccttcgtatggttcaaggtggttctgccaccagcaaccgcaataataaaaccgcacagtctcttaagaaactgggcttagtgcagttcaatgctggtcttgggtggtcattaacccctactggagtacttcaactcaacgagttaaaaggtaactaaatgaaaactttaattgctgttgctgtagtagctttatcagttctgtcattcaatgctcaagcatccagccgtgaaactctgttagacgctgctgccgactacaaagccaataatgcaaactttgtgaaccagggttacttcatgggcatggttactatgggtgtagaggcaggaaataattgtgtaccggagaatatgaagttaggagccatatttgacagagtagcttctattatcctgtacgaccgaaaggttaatgcagtaaaagtgccatcagacatggttctgttagcaattgatacagcatacccatgtattaaatcttaattagtaattccattaactttaggagagtaagtaaatggcgagcattgactcactgaccgtatgtaatacacgtcaggcccgtaactttattatccgtgccctgcaagcaggtaacgtaccgttcctgacttcatcaccgggaatgggtaaatctgcaattattcgctctgttgcagaagaatttggtatgaaactgatagaccatcgtctgtctacttctgccccagaggatttgtctggtctaccattccgtaatggtgaccgtgcagagtttatcccattcgctgacttattccctattgagggggatgagataccggaaggatataatggttggctcctgttccttgatgagttcaactcagccagaaaagaagtagtagctgctgcatacaaactgattctagaccgtatgactggtcagaaaaaactccatcctaatgtgatgattatatgtgctggtaacaaagctactgaccgtgccattgttaacccactgggtactgcaatgcagtctcgcgtggttcactttgaaatggaacttaacttcgacatctttgttgaagacgtaatgattccacaagaatgggatgaacgtctggttgcattcttacatgctaacccaggttatctgcatgacttcgacccagcccataagaacaaaacgttctgttgcccacgcacctgggactttgttaacaaagacctcaagaaccgtcctgaaggtgctctgccagatgaagattctatctactatgcaggacacgttactgctggtaaggctacagaatttgttcagtttactcaggtatacaatcgtgtgattacgattgagaaagtagtcaaagacccgttaggctgtgcactaccagaagataacaacctgtgttgggctaccgttaatcatctggctaacaaaactactgaagagaacttcgatgatgttattcagtacattgaacgctttaaaacattcacccataagattctgtacttccgtacagtaggtagagcattaccagaacttcaggctacccctgaatggcgtaaggctgctgctaacatctctcgttacattcacggataatcacagcatgaaccggatacctcagcacacactcagtgatgaacaactcatgcgtgagtatgaccgtactcaggccaacgctttcctaggaagcagtgcagcgttctttggttcattactgtgtagtcttaaattctcatggaaacgtgaggattgtcccactgcatgtactgatgggatagagcttcgtttcaatccagacttctttatctggatgtgtccagatgcaagaaaaaccgtactaatgcacgagctatggcatgtggcatatttacatggcatccgacgtggaagccgtgacccagaaatctggaatcaggcatgtgaccacttcattaaccttcagttagaggaagacggttacaagttcactggtatcgacgaaggtatttgcaaagaccctcagtataaaggatgggtcgaagaagacatttatgatgacctgatgaagaaccctcagaaaaggcagaagccgtcagggggtgttggagcaggtcttgctggcgacatgaaatccccctcttcggggcagtcccagggtgctgttgtcaacaacgtagtacgtgcaatgcaaagtcagaagatggctggtggaacaatgcctggtaagggtgctggtcgtatggaagaggttattacccaattccttaagccagtggttccatggcaagaagttctgatgaacttctttaccgacattgatgatactcattatacgtgggccagacctaaccgtcgttacactgacatctatctaccttcactggaagatgatgaaggacgtttacgacacttggcctactttgaggatgtatctggttctattagtagtgctgactctctgcgatttaactcagaagttgcctacgttaagagccagttcaatcctaagaagatgtccttaattaccttcgacgatattatccaagaagaaatagacatcactgaagaagatacttttgaagagattaagattactggtcgtggtggtacaagccttgtgccagtacgcgagtggattattaagaataagccaaccgctgcaatcatattctccgatatgtatgttcgtccaatggaagaattaccatttgatattcctatcatctggtgtgttctgaataatcccaatgctaccgtaccttttggggaggtagttcatatccctaaaggaatgaaataatggttgttaatggtaattctctataccgttcatctcagttgctggatatcccagaccgtaaggtatcagagcatggtgtaagctatggattaggtgaagctggttatgatattcgtatcaaacaagatattaccttctatcgcttatttgggctgattccaatggtgaaagtcgttgatggaaatcaagtatcacgccatctcggtaagttcgccttggcctcagcaattgagaagttcaacatgtccccgtcctgtgtagcaatcgttcacgataagtctacatgggcaagacgtgcattatcagtgttcaataccgtaatagaaccaggatggaaagggtatcttaccctcgaactggtctatcacggtcgtaagaaattgcatatcccggctggtgctgggatagctcaagtattatttcatctggttcaggaacctgctaattacaatggcaagtatcagaaccaggaaaacaaaccagtagctgctagaccttcaaaataaaaggctatccggcttaattaaggaaaactcatgtctgtatttcaagtaacacaagaaaatactggtattcgcctgacccttaatgcgaaccaagtaattgcagtgcaagaacttaccgcaggtaactctgctattactaccgtaggtggtgatgtagtaattaccaaagaaacctatcgttcagtacgtaattacctgaagaaagctcttgctcctgcaagcaaagatgctgagtaagtagctgcttaaatagcccagcatagttgggctatttgtgaagaaactaactcaaccccacataggaaccatcatggaatctttagcagcaatccttgttctgttatttgtattagctgtataccttatccctactatcattgcttttgcacgaggccatgcctccaagtggggcattggtgtactcaatattgtattaggctggtctttagtcttctgggtagtagcactgatttggtcactgtccaacaaaggtcagaaccaagttacaaacgtaactgttgttcaaaccaatggtggcagtaaatcagagtaactaacctaagcatcattacatagtgatgcttgtggaagttacttccagctcattgcttatccatctcctaacccaagcccacctaacccgtgggcttttttatttacaggtactcttatgtcaagcagacaaaatggtaagtctatcctgcaagggctggacttaagtaagctggaacaaactgcaatgcttactctaggtaaaactatccatgatcaagtagagaatgaaattgagttagatctttacacgacaatgcaggctcttgttcaaaaaggatggactattagcagaccttttccttcatacattcctccggaacctcatctgaaatctaaggtagaccgaatcatagataagttctggcttagcccatgtagggatgatacgtatctttacctggctcaaatacaaaagaatcctcgtactaaggatgtgttcaaaggcaagagcactacccatcattacccttggtatagaagaggtagtaaatactaatgcgtatcccattcctacggaaaagggaacgaaatcctgttctttacaataaaggcatagaggatgagtatgaactcaaccgtaaagctcgttcctacacaacaaaattattcatggggactaacaatcctgatagattactggactttgtttttgaacaaatctttatcatatacagcttagctatgtctgctggttcacaagaagtaagtgataaggcaagagatgctctctgtatgctccgcagggagtatgaagccctcatgtatgaagacttatactcctttaaaaaagaaaccgctgtagcgtgttctgtggcccttactgaaggtgtagcagtattacaagaactaccccgtagtgagtttaagctggtatatgttcaggttaagaaaattacagaaaaccgtagtggtatcaccaactatctaaggtcattctaatgattaaggcaactgtcattgcagattccgttcacccagaaacaggaactcgtattactacctttgaattggtttatccccgattcattcacagtgagtttatgacccaccgtgtattcaaccgtaatgcctcaagcagtcgtgctattcccacggctaagttcatcgaacaagttcgtaatgaaccagtgatgcctagtcactggggcaagaaccagaaaggtatgcaagcagaagaagaactcactcctatggagattgaggatgctaagtttatctgggataacgctgcatctgctgctgctgtgtatgcagaacagctacgacgtgggcaagtacataagcagattgttaaccgtattctggaaccattcacgcatattcgtgtagtggtaacttcaaccagctgggctaatttctatggactgcgtgaccacaaagatgcgcaaccagagattcgtgaactggctcaagcaatgcgtaaggcacaggaagaaagtacaccgagagcattaccatatgggcaatggcatctgccatatattgctcatattgaccgtgttggggcttacaatttctgcaaacgcaatcgagttacacgcgatgaaccaagtgatgcagaagtgcatggactacttctcaaagtaagtgctgcacgctgtgctcgtgcttcctataacaacttcgaaggacgaccatctactatcgaggaagaccttggcttattcgctaagttagtagaaaaccagcctattcatgcttcacctactgaacatcaagctacacctatgaaccttggtgaaaagtatgtgaataacatgaacccagttacatgggaacaaggtgttacatccatggataaagaaggaaatctgtactcaggtaacctgcttcactttatccaattccgtaagttaattcctggtgagactattactgaatgaaaaaactagctttgtacgcaatgctaattagtaccctattaacacttaactacgcatacaaagttgcctttgtcgtagaaacagatatgcagttcattcgagctagtattctgttctttgtgagtgagtttggattatggtgtgtttactactttgctcatgactatgaagctattcgtgagcaagaggaagtaaagaaacgcatgagacgtttcattgaaggaaaatagtaagtaaacctaagacctcctcctggaggtctttttttgattctattaactcttttaggagggcgtatgcctgctaaataccgtatcaaagacacaccagtaatgtgtgagggtgagaagggtgacattgtatatgcctgtatacaggatgacttcaatgctgctctgatgttaactcaaatgacaaatacactgcatgtatcagtaacactggaccctaccggtgactatccatgctttcccatccctgctcataacctggagcaaattcatgattaatcctgaagttattcatagcaaaactggaaaagctgttccactcagtgagattgcagttacaggtgatattgctgcttgcccagctaacatcgcttccttatgtatgtgcattgctgcactggcagaagaacgtaagttatggctggaaccaagcaaggaaatgatactggctggtatgtctgaactaaatgcacttctgaaagaaatgtatgacgaggatgggcaactagttgaaccaactgatgaccaaatctcggatgctgttgtattcacccttcaagcaatggcaagtaaacgttaattaaatttaagaagcaacacttaaactggagagtaaataaatgttagttgcagataccaatgaagtagctacctcagcgacactgggtggcaaagaaactattgcctttggcatttccgatgacccggcattcttccatgtattaagtacttccttgtataacaatcctactctggcagtagtccgtgagactatctgtaatagttgggatgctcatattgaagcaggtaagactgatactcctattcgtatcactattgatacagacaattttattacattccgtgactttggtaatggtatccctgatgaactcattggttccatttatggtgtctatggtgcatctactaagaaatccaacagtagtgttactggtggttttggtttgggatgtaagtccccattcgcttatacagatagcttccaggttacttcatggaaccgtgggaagatgtcagtatataacgtagctaaggctgcgattgagaatgacggtaagcctggcattgttcctattgttactggtattcccactgaggaatcaggtctggaagttaaattccagttaggtaagcatgacgtaaatacctttgtgcattacattatatctattgtatttaacggtgagattaaagctgaacttagtatccctaaacttgttaaaacagaagaaggtaatagtattcagcaaggtgactacactctactgaatacattaggtatgtcatttgaacctggttcatatgatatgtctgatagctggtataagggttatatgggtaacagtaacatattcgttcgttacggtaacgtaatgtacccaattgtatccagcccagctagtgaagaggctgtgggtcttatcctcaactttatgaacattattggtgctgctaatttagtagttcaggctgcaccggatactctagctattgctcctagccgagaaacactgtctaaccaaaagttaaccgacgatggtattactactctatgcgtagatttagtagaccgtatggagaaggagattaaggctaaaattcctgaagctattaagcagattgaagaatacgcctctaaatcatctacccgttattgggaatattcatctttcttacttgcagttacagacagaactgttcaacgctatatgtcctctagcttgtgggctaaacaacgtaaacatcacatcaaacattggcgtaacttatccaataaagcattattagctcgccctgaatatgcgggtcttaagaagctgtatagtaaggctatgagtgctcttaaagatactcgtgcggatggtacaagctacccattccaggaattagtataccggcatctacatttacctcagcttgctgctttaaaagaaactggtattaagtggtctggttacatagtgaaccaaggtaaccgtgttgatctggtgagaggtaaacttactgattactttaagatgggctataactgccatttgggtattggtattttcactaccaagaacgttgtagttactcgacgtttatctgattgtgcggactctttctcatacttccctgaatacaaccgtggagacttagagcgtacagcttttgttcacgtcgttggtcctaagaaaggtgcagcagaagaagctgtagctaagttcactgctatgggttatcgggtaattgacctcactcaatataatgagtgggacaaaccaactaactaccgcagagaacaagctaagatagctgctgagaaacgagctaagacgatagctgccaataaaaccaaagcagggggtaaaactaatgctctgatttcgttgaatgcagttctcggtactactcctgtacgaaataaaagtggggattgggattctaagccgtacattgacaaggattttactgacccaagcttccatgagaagtacggtttcactgaagtggaacaacctaagtactacgtgttagccaatcaggttagttctggtagtccagtaactgcccggattggaaccatgtggaaatggtatgagttatccgatgagatgaaagcagagactgttgtctgccgtaatcaaatcgaagctaacaaggctaaacgacgtggtgctatccacattgacgatgttcgttttaaggaactgatgcctgtcattaccagcaagggatttaagaagtatgtcactgaacaccgtattggtattctggaatacgtaggactggatgacagagagtattgggaaatcctagatattcttggtctaacgttcaaaccattacagaatctgatttttaaaccagagtatgaatgggcttatgatttcttaagaaatcgaccacataacaacaaagaaaaacttgttgaaatgggttgtattaagtcagttgatgacttagagccatatacaatgatggttaatccgcgtaatcataagtactttgaaatacttaatcagtacaaggggttattcagctatagctggagtgctggtgacatactacagagtctggacttggggagtttagttaaacacctcaagaaaaatccagaggatattcctgggtttaagtccctctaccgtaatcgtctaaataaactgaaaggtaactaatctgatgaaaatcgaactgatttctatcatcgcactggcagttgacagtcgaaacttaacattgtggaagcctgatggctccacaattgtatatccacagagcgacccacgggttgctcgtatcgtatctgaagcacaaaccaaaggcttgggaattaccaaagacctgatagaagtaaacattgcaccagaagtatcactgcgtaatgagtatctggaagcagagaagaacactaatggattcgtccgtttcttcaaggtagctaaagctaaactcaaagagttcttccaggatggtacagatgttcaacctacccaagccgtttctgatattaagctaggcaatcccaccaagacattagtatctaaagctatggatacattcctggctgtacaagctaatgaaccagaagtaacagtatcagatggttgctacgacagacgtgacaatctgatgtggattactggctgggataaggaccataactatcctgcactggttcgttttattaacgacgtaatgggttgggggtatgaacaaaccaacaccatgctcagacaggaatggcctgttgcagttcgtgcagtatccgatgatgaaatgggtgagtttgctaaacaagccaagcacatcaaaggtgtacatattgtatttaccagccgtaaacataccccaccaccttacattgaagtagctaaaactacgaaccaggataagctggctgctgcatccgagaaattagctgcattaggtgctattagtactgataacgctaactttcacactgatgtgaaggaagatgaagtggttgttgctgttaccaacgatggggttatccctggagttgagaacctgcaacgtcacttacgtcagtctgccaagttgaaagactacaagggcttcactaagttccttgagcgtctggctccggttattaaagaccgtctgcactcagtagaagacctgatgaagttcatggaaactgctgaattgcctatcgctgatgatggttcaatcctgttccttaaacgccttcagtataaagggaaagaagatggtaaacgtgtattcgttgactgtcactcaggtaacatcaaacagtgggtaggctgtaaagtgcaggtacgggaagacctggtagatcctgaccgtcgtcaggactgttctaacggtctgcatgtagcatccatgagctacattcgtagcttcggtggtaacgtaactgtccttggtaaagtagcaccagaagatgtgtttgctgttcctcagtacagcactaataagatgcgtgtatctgcgtatcacattattgctgaactacccgaagaggaacgttgcaatgttaacagtggtatctatttgtctaaaactgaagtaggtaagaaactacttaatgatgccatcgttgggaaccatagttcacctaccacacttattatggttggtgggcatcgtggtactaacctcaaatacactaatctcacatctggttctgtagagcaattccgtacagttgctagtaaagaggcactgaatatggaagagtcactgaatgaagctgtagcttctgaaccagtgaaagctactgaccttaaacccgttattaagaaggctcctactgtgaaagaacaaatccaggaactggttaaagagttccttaatgcaacaacaccagaagataagttagctgctgctgaccttctggtagaactgcgttccaaagctcgtaagccttgggctgcatttgatgtaggtagtgacgtggtagctaagattgctgatgtacgtgctacctatacaactaagcctattggtaaacctaaagctgttaagcaggatatgacagttaaacctacccgttctgctgctgccactaaagtagctccttctggtaaacacgttgataatctgcgtagcatcctgaacgatacgtcatattctgactatcagaaaggccatgctctgcaagactataaacgtcatgctaagaagtcattcactgcaatgggtctgactgaagaagaagctaaattagctaccaagctggttaaagcagttaagtaatagcctgttcaaatgccctcacttgtaataaagtgagggtaattttgaggaggaattgtactatgagtaaagtattcagaagtaatcgcaaagcaactgatgaagacatcattcgtatgaatgctgttgggctgtccctcgcaactatcgctaagacgttgggggttcaccccactacggttactttgcgattgcgttctttaaacattgaaccagccgacacacgtcggacgttcatggaaaacgtattacgtcctttaccaacccatgtggctgattggctatcagaacaagttggtcctgcttatgaaattcgttcatatgtaagggacttgattctggaggcatataataatcgccaccttaaccaagagagtgagcatgacaagttcatccgtttgtacgctggcaaatacggaagcctggttccggaaagcagtaccaaatccgacgagtaagaatattagtacccagattggttgtcatctggaagaagtagtagagatgctagacgagttatacgctaactcagaagatgcttacgatattcttcacaatgccattgcagcattaaccgaattgtctgatttaatgaaaaaagatgacaaagaggtatatgcaccgaacagccatcgtttagctatccttgatagtcttgctgaccagattgttacagcaaccggcgtcggtactttccttgggatgaatgtccctggagcattggctgaggttaatcgctctaactattctaagtttgaagatggggaacctgtcttcaatgagaacaagaaagtcatgaaggggaaagactacactcccccagatttgtccagtttcatttaacgaaagccccaaatggggctttctttctatggagtcatatatgaattggcacgctttatttgaatacatagatggaaagctctattggaaagttaatccatctatggcagtgcgtataggacacgaagcagggtccataaatggagatggttacattcaagtaggttacaaaggccatgtttatcaagcacacatagttgtgtgggaaatgcacaacggcccggttccaccaggaatggtcatagaccatgacgacaggaacagaaccaataatcgaatagataatttgaacttagttactcaattacaaaacaatagaaacaagaccaaaagtaaaagaaacacatctggtgttactggagtgtactggcacaagcgtgaccagagatgggtagcatcaatcaggatagaaggtaagctgaaacagttgggtcagactacctgtctggaggaagctattaaattaagaagggaagctgaaataaaacatggcttccataaaaaccacggtaaataactggagatttaaatgttttccaaacctaccaaagccccactgaaccaggggcaagaagcggttgcgaaggagttcttcgacttcctgctcgaccctaatgctaccgaattcaatattagtggcccagggggaactggtaagacattcctgatgtcgcacctcattgatgacactatgcctgcatacatggaaacttgttctttgatgggaaccaagcccctgtataacgaagttgtcatgactgcaaccacgaacaaagctgctgaagtactggctcaagctacaggacgtccaacatctacctatcactccttccagggtctgattgttaaaaatgactttaagactggtgaggctaatgtcgtaccatctaaatcattcaatattaagaagaacaaaatcatcttcgtagacgaagcatccatgattgatcgtcagttacttaagtatgctcgtgaaggtactcaccagtgcaaactggtatttgtaggtgatgcttctcagcttttacctgttaaagagaataagtctccagtgtatgcaggtaatatcccaacacactatctgactgaacagatgcgtactgatgcaccggaacttaaagcattgcaccagcaattgcgtgatacggtggaaggtaagacaggcttcctgccaattaaatgtatcccaggtatcattgactgggtacaggaggaagagatggagaaattggttctcagtcacttcactcaacctaccaacagccgtattgttgcttacacaaatgaccaggttattaattacaataactacattcgtgaagctaacggttatgtgggtgaatactccatcggcgagcagctggtatctaactctgctgttcgcttgggtgtggataatcgtttatctattgaacaggacgtaaaactcattgaccaggatagtagtactcgcatgattaaggttacaggtgacctggaactggaagttcgtgatagtactcttgacctaggctatggtggcattgtaagtgaagttccaatacctactgacccagactacttcaaccgtttagttaagtggttaggtaaagaaaagaactgggaaccttacttccgtcttaaagaaaccattccagacctacgtgctactcatgcgtgtactgtccataaatcacaaggctctacttacgacacaatctttattgatgcaaatgacctctcaagctgtcgccaaccggatatggttgctcgtctgctttacgtcgctgtgtctcgtgctcgtaagcgtgtagtgttctatggcaatcttgccagtaagtacggtggcctaactttctaagggaggatatatgcctcagattggttcagcgactattggtcaagttgccaatagcagcgagatagtcaagcatctgttcttagcagaactggttcgtcttgatggtgtgttaaacggtatcattgataagaatgatcgtatcaatggtgtagatgtatcagctggattcctttaccagggtgagttctatcagcgttctaacgctaccagacctccaacctacggtgagcgattaacgcttaatccagaactgtggcctgcaatggacaagtatctgaaagcctccagtcgtttgattatggaagtacaccttgtgaaccagactgtatatcgtctggttcgcggttgtatgtcctatcaggatgtacgtgatgctctgcctgagtgtctggtagcacaagaccagacgggtcagtacaaaggtctgcctcgtactcgtgaagcagcctggacacttgctggtgatgctatggcaatcaagcagtatgagaagattctgccctctattgagtattatgcagcttcccatctgattttctaaggtaaagctatgcgttacatcacctctcaagatactggtaagtatcctattgctatcctcggtcatcaaatccgaagggaggagatgattaaaacctacctgctgccttatgacctaagcatggaagacttcatctttattgaacttcattctgcccctggcaagaagaagactcctgcaagggagattaaggagttcatacagcaggaattacagcaagtactggatgatgcagaaactcaatatattatctgtactgattctgactacttcaaaatactgactaaagaggctaaagcagaggctaacctcggctatgtttgtgattcagtatggggtaagcagaaggttatctatacgcctagctacaggcaagtcttttatgacccacctgtagtgagagccaagattgctcagggtatggatgcattgcttaaccacattcgtgggcagtatgctgaaccaggccagggaatcattgagtttgaagcatatccggatactccagaaaagattaaagcctggctagaccagttgcttgagatgaataagccattggctatagacatcgaagcattcggtttaaagcactataacgctggtataggaacaattacattctgttggagtaagacgcaaggcatagcctttaatgtggactacgagccaattcctggggctacagaagcaccatatgggcgtatcaacagaaatgatattgttcgaaaccttctgcgtgagttcttcattaagtacacccaacggcagatgtatcacaacattagctatgacgtgtacatacttatctatcagctgttcatggataacctgattgatacggaaggcttactgcacggcatggagatcatgctacgcaattgggactgtactaagttaattacctacttggctactaacagttgtgctggtaatcaccttagtctgaaagaccaggctcaggaatatgctggtaactatgctcaggatgatattaaagacatacgtcttatacccaatgagcaattgctacgctacaacctcattgatggattgtgtacttggtacacttatgagaagcactgggatactctcattgccgatgaccaactagatgtttacaacaacatctttaaaccagcctgtgaagacattattcagatgcagttaaccggtatgcccatgaatatggaaaccgttaaccaagtagctgaagaaatggaaactgacaggaaccaggctctgaaaactattcgtgagtctaacctcatgaagaactttaccctgatgcttcgtcaggaatgggtagacgataagaatgctaagttgaaaaagaaacaggtaacactggctgattgtaacatcgagtttaatcctaactctagtccacaactacagaagttgttatttgattatatcggcttaccggttcttggtcttactaagagcaagcaacctgctactgacggtgacactattaaagcactgcgtacacatacgcagagtgaagatgttaaggaactgctcaatgcacttatcgactataagcttgtggataagattatcactagctttataccagctttcaggaatgcccaaccgggaccagatggctggcactacctgttcggtaacctcaatctgggaggcacagtctccggtaggttatcggcttcagagccaaatctacaaacaactccatccggctctaaatatgccaagaagattaagaaatgcttcgaagctcctccaggctggatattttgcggcttggatttcgcctcgctggaagacagaatctctgcactgacgactaaagacccacagaagcttaaggtatataccgatggttatgacggtcatagtcttcgcgcatatgcttattttggtgagcagatgccagacattgaagacacagtagaatccattaactccattcagcataagtacaaatcattgcgtagtgactcgaaggctccaaccttcttacttacctatggtggtacttatatgggcttaatgaaaaactgtggcttctccgaagagaaggctaagactacagagaaacgttatcacgatctctatgtagttagtgatatgtgggttcaggctaagctagatgaagctgctaagactggttatgtaactgctgcatttggtttgagagtgcgtactcctttactggctcaggtattacgtgggacatgtaagactccatatgaagcagaagcagaaggcagaactgctggtaacgcattaggtcaaagctggtgtctactgaataaccgtgctggctcagagtttatgcgtaaagtcagaaccagtgagttcaggttagatatacgcccttgtattcacattcatgatgcccaatacttcatgattcgcgataacatggacaccttgcagtatacgaacaagcacttggttgaagccgttaactggcaggatcatcctgatattgctcatccagaagttggtttgggtggggaactatccttgttttacccaacgtgggctaatgagattgaaattccaaatcacgctaccccagaagaagttcatcaaataattcaaaaggcattcgcatgaccaaaagtactaaagaaactgtagtcaaaaagtatcattggatggtggcagcacaggtaatcttccagcttcctaaagctgatgatggctccctgcttaccatgaacacaatgctgctcactgacgaacctcatgtgacctataaagatttggctcgtgccaatcactcactgaagattagtctggatcagcgtttcgatacctcagttgatttgaaagatattgtttatctatctattaacaacctgggcctgatgtctgaaccagagttccaggcaaacatgattcccaagggggaataatgactaagctctccggtggtcttaataactactatgtagttacaattaagaatccccaacggaaagagcaagagccataccaagcagagtgtgaggatattatccaagcactaggcatgaccttcgatgaaggttgtgcctttaaagctctatggcgaaatgctgctgcccgtatgggtaatggtaaacctggaaacacttcagtttatgactgtgagaaattggttcattacgctaatcgtattcttactaaagagaagttagtagatgaattacctgccacagatatcactgctactgggagatgctggcattacccggggaatggaaagccttatctaacagtgaactttcagttcattgaggtagcgtacaaaggtgaactagataacatagtcagctatagcttcgatgaggtagagagtattcgttggaaccaggtgcatagatacaggattacttactgatgaagataaccaacaaccatgatgtctcgctggccctggctgtatggctattacatgacgagtatgattatgtagacaatcctaagtatctgtctgtaaccacactgcttaagccacttaagcaaatcgtcatgaagcatcgtgtagacctcagtgaccagtcaattgatgttatggattttgtctccacatcaatgggtactggcttacacgattctattgagaaagcctggaagttaggccataagactgcattgaaaaagttgggttatcctcagcgagtaattgatgcagtagtcattaacccaaccaaagcagactttgatgctaaccctgaccttatcccaatctacattgaacaacgtggaaccagggtagttaagggttggactatcggaggtaagttcgacatcgtaacagaaggtctattgcaagactttaagtctacctcaacctattcctgggttgctggttcccgtgatgatgaacacaagatgcaaggtagcttgtaccgttggattcacaacgacatcattaccgaggatgtaatccgtattaactacatcttcactgacttcatgaaacacatggctaatagcaatccgaactatcctgctaatcgtattatgcataaggatattccgttgttatctgtcgataagactgaacgttgggtagaagagaagatacatctcattgaaaagtactgggatgctcctgaagaggaaattcctgaatgtactgatgaagagttgtggcgaacagagccacaattcaaatacttctctgatgcttctaaggtagatatgcctggagccagaagtaccaaaaactttgacgatatggcatctgctcgtatcttcatggctgaaaaaggtggcaagggtgctatcaaggtcgtggaggggcaggttaagcgttgtttatactgccctgtcgcatccatttgcaaacaaagagagagatattttccatcatgagtattgaccttaccggagtagtgcatcatcaggcgattgaagaaatcgtagatgtgctctgcaataaaacccagaacaatgaccggggattcttccgtgtcgaagtagcctacttcttggctaaaatggcatcctgcatgggtgcaaccatcgtaactaaagaccgtggtgacctgccggtaaacatctacgctatagcgttggctacatctggtttcggtaaaggtcactcagtaaatatcatcgaagacgggttcatgtctggcttccgtaaacgctttatggaagacaccatgcccgtcatcgcaaatgatcgtctatggaagattgctaacgaacgttctgctcgtcagggtactgaccagcaggaagagtttgataaagttgaggcagagtataaacgtgcgggagcatatccatttacgtttgactcaggtactccaccagcagttaaacaactacgccataagctgttaatggctgggtgtggttcaatcaatcttcagattgatgaaattggttcaaatctgttggctaacatggatgtactaaccctgttcctggagttatatgaccaggggaaagtaaaacagaagctaaccaagaatactgctgaaagcgttcgtggtgaagaattggatggcaaaactccaactaacctgctgctatttggtacaccaagtaagctactggatggtggtcagactgaagaccagttctatggctttctagatataggatatgcacgtcgctgtctgtttgccactggtcacttagacaagagagcacatgcaacattaaccccggaagaaatctaccgtaacctgattaaacaagataacgtacagactcttggtaagtgggctaaccatttccatagtctggctgacccaaacctatttggttttaagatggttgtagaagataccgtgggtattgctctgattgcttacaaaattgattgtgagaagcaagcagaagctatggctgaccatgaagatattcgtaaagctgaaatttctcaccgttatttcaaagcacttaagctggcaggtgcactggcgtttgttgaccaaagttcattcattgagatgacccaccttaaacaagcaattctgcttgtagaagaatctggagcagcatttcagacaatcctcaatcgtgagaaggcttatgtgaagctggctaagtacattgcttctgtaggtaaagaagtaacccatgctgatttggtggagtctttgccattctataagagtggtaatgcagctcgtaatgagatgatgactcttgctacagcatggggttacaagcagcacatcatcattaagaagaccttcaatgaaggtattgagttcttccgtggtgaaactcttaaagagacagacatcaatgagatgattgtggcgtatagtgatagctttgcttatgactacattggtgaacgtgtaccgttcgaccagttgcatgtattaacccaagctcccggtatgcactgggtaaaccatcacatgaagaatgggcatcgttctgaagaaaatgttatcccaggatttaacatgattgttattgactgtgatggtggagtacccctgcatacgtgccatgaactaatgaaggaatataagttcatgacctataccaccaagcgtcatactgatgaagagaaccgcttccgtctgattattccaatgaactatgagttacacctcgacactgaggaatacaaagagttcatgaataacgttatggcttggctaccatttgaaacagatgagtctgctaaccaacgagccaagaagtggatgtcctgtgagactggttcctatcattacaatcttgatgcgaatctgttagatgtgcgtgactttattcctcgtactagtaagaacgagcagttccagaaccagatgaaggaagtacagtcgttggataatctggagcgttggttcgctagtcgtattgcctccggtaatcgtaataatcaaatgattaagtacgcactggcattggttgacagtggttgggacttttctcaagtacagcaagccgtccacacattcaataagaaactggctaatccattaccagatgatgaattgaatgcaaccgtaatggtcaccgtggctaaacgctacgctggcaaataagtaaacaggagtctttctttggtttgaaggactcctaaattaaacgaggaaaaataatgtccgaagaaatctccaatgatatgaacactcagctaatcctgattgcaggattctcagcgagtggtaaatcagcatcactgcgtaacatcaggaaccaggaacgctggctctatctgaatactgaagcaggtaaacgtctacctttccgtaacaagtttaatacctacaacattgaagacccatatcagatttgggaagcatttgatgttgcatccccaggtggtgaaatggcagacgatgttgatggaatcattatcgactctgctaccttcatgatggatatgctggaatctcagtatgtactgccatctgctaatactcagaaggcatggggagattttgcacagttctttaaaatactgctgcaacagaaagttgttaaatttggtaagccagtaattattactgcccatgccaaagatgaactcgacgaagctgctggtgtgattaaaacattcatcccagtgaaaggttctctgaagaacaatggtcttgaggcttacttctctacagtggtttacgcagagcgtgtagacattaaagagctggagaagtatggcaacaagatgcttgaaattaccgaagaagaacgtgacttaggttataagcacgtattccagactcgcccaaccaagaagtctgttggtaaacgtctacgttccccaatgggtatgttcgataagtctgagacttacattgataatgatgcccagaaactcttagaccatctggctgaatactacgcttaagcgtttgcctggttgttaatcacttattaggaaaaatattatgtcactgttcagtaacttgaaagaaaaaaccaaaaacgttgaagctgtaaaagactcccttggtggtggtggcttcggtgcaaaggagtcagatatctacaccggtactgtaaaagtagcttacgtaggtaaagctgactctggtgcagactggatgcagttaatcattgaaaacctgaaaggttctgatggtaatgatgctggcgagttccgttcacaggtgtacttcacttctggtaattctaaaggcaataagcctacttacgagaagaacggtaaagaatacttcctgccgggatacaccgtcattaacgacatgatgctgatggctaccggtacggaactgcctgaagctgacttcgaagagaagattgttaaagtctatgacttcgatgctaaagcagaagttaataaatctgtcatggttccagtagacctggttggtcagactgttaccttcgccctggaaaaggttctggaatctaagcaggttaagggtgacaacggttacgttgattccggtgaaacccgtgaagtaaacgagattcagaaagtgtttcacccggaactgctggtcacagtcgtcgaggctcaggaagcagagaaggctgagaaagaactgaccccagaactggctgtattttatgcagcatggttagaaaagaacaagggtaaaacccgtgataagaccaagggttctgctggtggtaatggcaaaggtggcttgcctcctaaaccaagtgctggcacgggtactgctcctgctggtggtaaatcactgttcggtaaacgttaatgaaaatcccaattgttggtgcagacattagtctccgcaattggggtttagctcgtgggatgctggacattgagtccggcgtcttcgagcaggtcgaacttaaactggttcaaactgaagttgaccacaacaaacaagttcgaaccaactccaaagatatacaagccgctcacgatttgtttcttggttgtgaagaatggttacggtctgctaaagcagtattcgtagaagtaccagtaggctctcagtctgctaacggtatgaaatcctatggcgtatgcgtaggattaattggtgcatttcgtgcattgggttgtccaatctttgaagtatccccaattgaaaataaacttgcactggtcggtgataaaactgcatccaaagacacgatgattcgtgctgcccatgctatctatccagaagccaactggctcacagataaaaaaggtaaacttctgaataagaatgagcacttagcagatgcaatcggtgcaatccacgctggtgtaaatctcccagctttccaaaaccttcttaatttaataaaggcgtaatatgcaaatcattttgaaccagtccgaagtagaagctgctgtacaggcttatgtcgatgatcaaatcaatcttgctggagacattagtattgtcatcaatgcagatggtacagcctccgttggtattaacgaagaggtaagtcataacgatgatactccacccttggtagagaagaagacacgtcgttctcgtaagaaccctcaggaagctaaacaccgtccggtagaaccggaaccagaagaagtggttgaagaggtaaagggagaagaaacccagacctctactggtggtccgaacaagagttctacgccggaacctgaagaagaagcagtaactgaaccagaagcacaagaagaagttgtgcaggaagaggttaaggctgaagaaccagcagagaaacctgctactaagccttcactgttcgctggccttaaacgtagttaatctggtaggtggctcagaagctgctgctaggtgtggtagtgtttatagtcctgatgctactactggtcaggattatagacgtgtcggctccatacatagcttttatcatcactgtcattatcctgtggaaatgcagtggtaaacacggtggtgacaagccgccagagtaacaacaaccgaaccagtcccctttaatactctccgaaggggattggttcaaacagggttaacatgaacaaatttactattcactggctcaatggaaaggttagttctttcatgggtggagaacctgctgaaggaaaaaaaagcattccacattgactcagaaggctgcaaaatcttaataccgtatgcttggtataaagatggtgaagtagaagcattgaagaagagcagttaatatcgtgaagggttctgttagaatcctttgagataggaactcctatcataacctttcttaacttaatctttgccgtatggcactgacgctaggggtggccccccatccgtcagacagactattttaagaatcggttatcacagaaaatgtaaagcaacattcgggttaatcaatggcctcttcctataggggccatttctgaatcttaggctatatcccaaaggttagtatctttaggataaggcttcagatcccttatcaaactaaccgctcaatgttgagcattctaatcacataagcccctatatgggctgggttaaatgtcggatagcctagctacctacaacatcgaactgttagatcttacatgcaatatagggtataaagggaggattcgtcccctcccccctattatgggctatcggtgagtgcattagttgattagctgtggaaggtaggccgatgtccacaagcgtggcccagagctagtgtactctccgatagttttcgtaagcgattatgcggttttttagaaacgaaccaataacataagtgcaaacgaagaagcgtatctgatggcagcttaataagccaagcgtcagtcaggagtgagtcgtcctgattatcaaacgaccgtggagttctcccgtccatgtattagaaacgggggactaattatcagttgcacgagatggcttgacatgttcaagtttggactaagtgtgacaccgctagattggagggctgctgcggtaagctatagactccaaccggaggttcgaatccttcactgataaccaattcaaagtagcattgtatatttaaatgtttcccggcatttaaagcacccaccgtgacagtgctactctaaattggaagaattatgggggtaagtcgtaaccatacgacggcgtaagtaccagatgagacttctggacgcccctaccatatttgaggtgtaacagttaaatccagttgccggaagtgcaattctagatacgctgccaatgtgtgaacggtaaggctgtacaggactcggactcccacctcaaaccaaagtcgccaggtacttatggcaaacgggtagtaacgaactagtcattcgtcaaacgcccaacccaattatgagtcagcaagaacgccttcacttaaatttaaacaaaaaagcttaacgcaataattatgtaggggtatgtaaggattgcgaagaaggagccagttagagtctggcatgactcacctattaatacccggtaggcttagtggtaaagccccactagtaaaccaactaggacgcaggttcgaatcctgtccgggtaaccatattatgtccgcttagcttagactgggaaagcaaccgactaataatcggaaagtcactggttcaaatccagtagtggacacccatttagcagtaacatagtcctgattgcatcgcactctaaagacaacactggtaagacagtccagtggctgctattgtattgttattcccttcgacgggaatttcgctggagaatgggaactccttaaatcctagcctgagtaattaccacaggaacgggactatcaatcccaagcctggtcagcgtggactgtcttcgtggtaagaaccaaaagcctcccagctatgggtaaatagtactaagtcccctggagccgtcactctgggggacttttttatttgagtattaataattggataatcaatatgattgacctaatctcaaccccgtatgcctatgaggtaacggataatcgaggacgcaagtctttggtgtttgcaggtagcgtagcctataacaacgcagtcatgtttaagtacaaactcaaaccactctatgaggctaataatggcaacagtaagtaaagaagcaatcgaagctaagattaagagcgtctactattttaatggagctgatgcagtgaagtctgcatttgttgatccatctgcactcccggcagatgatttggctaacctgggtctgataacctattgcattatcatcttggaaaatggcttcaaagttgaaggtgtatctgcctgtgttgacccagctatctatgatgagcaaaaaggccgtcagtatgcatatgaaaatgcattcaataagatttgggaattagaaggttacctgctacgtcaggcactgcatgagaaagaagagactgctaaagctctggcttcctttgcagaaaacaacacctgtgatggtggtggttgtacaatctgattcaaaagtgtaaggtagtttttaccgaaaggtactgaactacccgacatgtggtaaggctcatgaagccaaaacaaaacaagccctcctagtgagggctttctcatttgaggtagttatgtcagaagaaattaaagtccattttaccaattatatcggaaccaagtgtgtaaatggtttccgaatgaacaaagaaacatactgcaaacttcgtggctgggatgtacctgctaatgaagacccattagaagaaggttacttagtagagtacccagactctaagtctaaccatcctcagttccgtggctatattagctggtcacctaaatctgcatttgaaactgcgtaccatgacgtagaaaaaggttgcacctttggtcatgcagtagagcttctcaaatccggcttcaaactagcacgtaaaggctggaatggtaaaggaatgtacattgagtacgttgctgctcaagaatggaatagcagtagcttagagcgtacaggacttgctgatgaattgaaacctcgtccatggttaggaatcaaaactgttgatgaccagtttatgccttgggtcccatcccaatcagatatattagctgaagactgggtgttagtttagtaaaaattaaagcccctctaatgaggggctttttcatttagttagctagattgagccaagggttaaggttatgggcacgaagtccctgaccgaagccccaggagtaaccgagattgccttgtgcagcaatactgaagatgttgtcctgaataggtaaaccaacattaccaaacatggtaggagttggagccaacatagccatagctgcgtgtaccgggttgttacgaatcatggatactgcaatttttgcagaacgaatcttaaagttatagaaccacataagaccaacactttccatatacccacggaagcgaccaggcagacggtcatagttaatgaactcttccgttacacgtccaagtgcttcttcacgagtcttacctttacgctgagtcaaatcatcatagatgattgctttagcaataaagtcagagtactcaaccgtcttctggataccctggaataaagcagtatccttggtgataagggcataacgtccagcattacgtacagacttaggtaacttatcagccagtttatccatgtattcgtgaagtttaccttcagtaatcaggatgtcatctcgtccaataccagcatctgcaattgaagaaaactcaccagcttctaacagaggccagatactcatacgcttatgactatcagtgatggactgaatttcagccttaagcttacgaatctggttcgggttagtagctgcacgtaactctgcttctgcatctacctgacgcagacgagatttcaggtactggttaatctcagcagtcttctgtggaatgctcttagcaatgttcttaacaggtacaccacgaccaaccatctggtaaaggttagccaggaagttaacagcaggaacaactactgatttaactacaatcagagtcttagcttctttaactaagttttgaaccaggttctcaccacccattacatacttataagcacggttgccgaatacacccaacatagctttcttgaaggtatccagtgtttctggtgaccaacgagaattgccagaccaggcatcacctacggaagctgcacgatagcccagtgcatcattcagcatgtcacgacgtacccacaactcaccaggaccaaacagactttctgctttctgacgagtttcactgttcatcagcttaagggcatcagcagttactgggtccagtttagaaccaagaaggttaacgtactgtgacttgttagaggcagacattttaatgtcgttttcatacatgctatgcaggttctcaatcagcatatcattgaaacgctgagccttagcttcctctacctgacgaccacgccatacaccaattgcacgagcaagatggttctcaccctcaatgtgcttcagcatgttagggtcaatagattgctcatatgcaactacattacctttgtcatcatatacaggcagcagtggttcattaccacgctcaccacgagccagtgctttagtgatgcggtctacggaaggcttgtcagtgatacgaccagctaccatagaacctatcgtaaagcctgtaccaaggtctacaccgccagcagtattgcgaacgttctgtagaataccttgtgagaatggagcctgtgcctgtacaggtgcgaagtagtaactacgtgctggaccacgactagcagagctaccctgataagtacccagacgtacataagacttctcaatcaaatcagcaaactgactatcttcagcaacaatcaggttaacaccctgtttagtctcaccaggaatgtaacctttatactggttcagggttgcacgcatgtcagatttggctttagccatttcatctttacgctgtccaaccagataagaagtagcaaaatcaatcccatcagcttctgattgagccagtgaagataacatctcacggtcagtcttactcattgcttccagtgcatacagagtaatcagtttatccagttgagctacatctacagtagaacgtgcagcctgtcgttcacccagcatacgagagattgcagtagcattacgcagcaagttattaccaactgtgccattaatcatgtactgagccagttgcttagatttacggctaatcaaaggccagttacgtcctgcttgtttctgcaaatctgcttccagcttattcacttcacggtcaacaatcttttggtcagtcagcaagtcacgaatttcacccagagacatagtgtcacgcagaacagctaagtcggttttacccataccggtatgcattgctttccactcatcattagtaagcttacggctgaacttagatgcaatagtggtaggcaaatgttcacggaactgctgacggtcagcctgtacctgtgcacgcactgctttaatcaaatcatatacagaagcattgctcttagtacgaccagttaagtcattaaccaggtcatggaaaggttgccataccttaccctggttcattgcagccataacaccctcagctacgattgcaccatttttctctgtagcaatagcagctattagttgtgcagcatgagcagcacctttaaccaacgggttcttggtattagctgcaacttcacgagcaccctctaaagcacgggtagacagtacatcaatagaatccaccagatactggttagcacggtcgatagcattaccactaggagtagcaatggaatcatagaaggactgtgcattgagactcgtctgcatgattgtctgagccagtgcatccataccttcctgtacgttggtagctttagtatctcctgctacacgagcattcagactagccattgcagcagtaccgatgttagtcagcattgcatcagcggtattgccagatttcttgtctactttcataacaggaatgtcagccagtactttacgcacttcttcacttaccattgccagaccaacaaaggtaggcagtaaggaagaacggccttgtgcatcaaactcaatgttgttagcacccatgatggtatcgaacttctgctgtgcatagtaacggtcagcagggttagtactatctgggtcagccatgaatgactcaacggtcaggttcttagtaacatgtgtgtagtattcctgtgcacgagccagagcagcaggattaatagcagcttcagtagccagtgcagcaacaatgttagtaaagagacgttgttcctgcatattcatagtgaagccatgagcctgaacatcacgagttactttagtcgcattaaccactgcatcagagaacttacctttacgaattacttgctgtactggttcagaaccaatgtagtctgtaatcagtttatcaaaggttttccctagctcttccagacgagtattgtcaccatatgctttgttatggaacaaagtagtatctttggctacagcagcagtaggtgcttgaccacgcataactacagcagagttaaacagtaagcctgagaacatatcatctgcattagccggagctttcttacgcccgaataccagacgtttgattgcttcatatacagcctgaaccatggttttcagtgcagtggttttcttctgcttgctaatcaattcacggttggttaaaccccaagccatgtactcgttaagtgcagcagctttagccattgctggttcaatgaagccattagacaaatgaccattaatggtattaagagcatctgcatatgcttcacgtactgcaggagtttcatccttaacatccagagtgcggaactggttcatcaggtcttcaatgttctgaactgcttcattaggagtaccttcatagtgagctagtacagattcaaaagtagaagcatgcaccaattcatgaaccagagtctctaaggaaggagtaactaagtagatggtcttatcttcaaagttagtccaaccgtatgcattacctgcttcagcagcttcaatatcttcaggtgctgggcgagtaatgttcttctcaatagcgtaagcatccagttgaaaaggggttccatagacaaccttgtagtctttagcagcaagagatttctgtacttctttcaatactgcttgctgttccggagacatctctttagccagcttagagatagcagtattagatagtagacgtacaccagacttcagtactcgaccaacctgttccattgccggtgcttctttcactggttctgttttagcagcacgtactgcatcacgacgcttgtttaactcagcatcaaacagttcgttcagcttagctacttgctggtctacagtcagaccttccagagagattttaccgttgttcacataaggagcaccaacagcagccatctggtcaacagtagtctgtacctggttcattactttgtgacgaatatctacacccagagcaatattacgcaggttacgttcaatctgttcagcaccaacacgtaacaggtcatcggtagctccttcacgctggtcatattccagagcagatttagcgatagcctgtttggtttcatcagacagtttgctgaagtctacactcttcatgaacttagcgaaggagtcataaacattcttgatagggttaccctgccaggaagtgtatacagcctcattagctttacgacttgcatcagtgatgttgttgataccaatgttcataccatcaaagattttcagggtattcttcggagcacctttcatagtagaaagggtctgcatcatcatgccatcgccagtaccaatggtcataaaaggaatacctgcaacacctgcctgtgaaggagcatagatgctcattggcacacgcatacggtcatctaagttggtagccagtacttggttagcaacatcagtgttttcactaccggcaatgtagaaagtctgtgaaccagtctcaatcattggagctagtggggataatgattcctggatttcattcagttctttctgtgttaagaaatcacccttcttccaggttgggtctttttctttttctgccagcttagcctgtactgcttgttggaacatgtcttgtagaaccaaagactgaatctgggtagccttctgcaagttctcagtagaatgcatcagaccttccccaacagtattccggataccagtacgcattggttcaacgaacaggtgaagcatgttctcttgtaagttcttcagggcattacccgatatggtaaacttctgagggtctaacttaccagtcagagcaccttctacctgttgaatagacaattcacctttacgcataactggaacattaccagtcagtgcttccatagaagtaaggaaagtatccagcatagcctgagcatcagcctcagacgcagcctccttaccaaacattgccatagctggggaaatactagggtcagcagcacgagcttgcagaacatcactgaagcgttcatagatggtatcagtaattgcactaaccatcttgccagcaataccacgagcacctgaaccatagatggtaatggtcagtgggtttttagcgataccacgtttcaggtccagagtaccgtcttcattcaggttaaagtctttaataaacaggtccattaacttctgaagatgattcatttggttcataaccggaacgttgttacggtaagtagtacgtaactcattaagtgcttgttgcagaccattggtagatgcttcatacaggtcaacactgtcatcctgtgaacgatgttcattcatagtcttaccagctttaccgaagaacagaccacctttagcagtattcttaatccagtctgaagtgaacttaccaccagtcattaataccattgcgttgattggtccgttggttacaccatcggcttcaacgtacagtggggtattaaagttggcacggtcatcactgttcaggtaacgggcatattccataagagccatgagagctacgaatgatttatcgccacccaaagaagtcttcagaatatctactgcatcagctggtaagtggccagacttatcaaactcaaccatcatatcaacagcaggtttcagattaccttccagagctttggtcagcttttcagacatagcttcacgggacatattatgtaccttgatacccaatgcctgagccagtcctagctggaagtcagagaatgtttggctgttttcattactcaagtcaatagtagagaaggttggcagaattgcttcacgaaccagtttactggattgtgggttgttcttacctaacatctgcatacgacctacacgggtcatgttgtaaccatagtgaataggcgtatccagaccattctcctgttcctgtaactggttgattacaccgaacagggaatcatatgccatagacactgacaggtttttaccctccagtgacttagcagtgttcacgttcagcagttcaggattaagagtaccagcacccatcagttccagaatgttgtcacgacctaatgcttcatagaagttaaccatcggcatgtgtacacggaactcggtagcctgttctgctttaagagcagctttctgctctggggtattcttaacagcagggttacgtaactgagtttgagccacggaaggaatatcatcaccaaagtacattttctcttctggttctacgagaacagcttcctcgatagcagtaggaaacttgttaatggcatcgttatcatccagcttctcaatggtatacagaccgacggtcttattagagtctgggtcaatctcagacacatcaagcatagactctttaacttcacccatctcaatgagagaagacagaatctctgtagccattgccattggaatacctttggtataacccagtggtgcattaggattacgattcaatccccagtaagattcaatcttttgagccagtgagttagtagcttcaaccagagtctgagcattctcaaattcagccaggataccttcaggtaacaaggatgcttctactccagtaatagcagctacatctttcatgtctttaacagcagcattctgtgtagcagtcagtcgccattgcagaccagcaagtacagcagtctctaacaactggtcattgaacttaaaggtgtctccgtctttctctacgatattaagtaacttaccacctacccaacggttagcctctgtgccttctgcaaagcgtttaccaacgttcttattagcaagaaacttagccagacgatcagacagagtagtcttcagagtttcaccaaagcccattaagtcctgataacgcttaatcacatcacttgtgagagcgttattttctttttgagtgaatgcttcaaagcgtgcagtagaagacagtgcttgcttaatatcagtcaaaggggattcagaaccaatggtgcgagacttaggttcttccggcagggtaaatgatttcaggaactggttcggtgtcttgtcattgttatagacagggaaaactgtttccattttcgttttagtttcagctactttttgagtggtatcctcattggtgagggtagcatctactgtttcagacttagtagtagagacttcttctgcttttgaactagcctctttaacaggaacagtcttattttctaccactggtttagctttaggctgtacagtagtagtagtctcttgcgctggtgcaggagtttcatcaacctgattcactggttcattggtctgttgagactgagtggcatcaagaccaccttgacggaactctttaactacctgggcagcaggcttgtccagacgtgaatctaatggagtaaccttcacatgagaaacattaagctccgggtaagccgtagcaagtgcgttagcaatatcagctacggttttggcctccagtcctacttgctgggcaaacttaaccgacttggtatcatacggattgacaccaagaccagtacgactacgtacccattcacgggagggagtaagagcctgataatggacagacttattcttatccgcattcccagaaatcagatgctcattcaacgctccgaccttattctgcatgtgctgggcgaacttcataaagtcgtcgaggtaagcggaagccaaatcgaagttaccagagttgtacgcagaacgaatgcgtttagcatgttgcaacgcagagtactgaccttcattagaacgagactcgtcggttttaatctgtttactaacaatgtcttgaggacgtaagcctagttcttctgctttagcgtcaaattctcgtgctccttgcaatagagcagcagcagattgcagggcagcacgctgatgattccccagtgtaatcttaccttcacttgcatgtttcagaaccatgttcactgagtctgcatccagtacttctggagacatatcagcagccatagcaatgttgtttgcttgggcttggttagcttcttcggtagctttcagtttacctgcttcagcctgttcctgaatcatagaatggatggcacggaatgcacgaagtacctttggtgtattctgaacgttagccatcaggccggagaactggtcaacaatattagcagcaggagaaccctgttccagattagctaaagcaccaggatcacggttaatgaagctatccatagacatgatgttgtcatacatctggattgcagcttccatttgaacgttagggtcttcggcagtattaaccaggtcagccatcttctgaatagcttcaacacggttagtggaaccagaaacagcttcacggattgctgggttagcttgttccagttctactgggtcaaatttcattgcctgagttaagtcagcagcatactgagtagcagcagctttctcttcaggagaaatatccattgcatctactgcttcttgtacagttgcttgtgcttgttctgcttgagcagtagcttcttgtgcagcagcattaaccgtagcatcagatacaggggaagcttgttcattacgcttagcaacttcttcgccacgctgaaccaggatgttagtaataggagaggcagcttttgctaatgcactaccaaccagagaagcaccagccagagtagtacgtaaagcaggcccagcagaagcaccaacagctttaacagttgtacctggagcctgagcaacaccagcactaccgaagccgtagagtgcaccaagacctgcttgctcaccgacacctttaagcaaatcacgcttagcatctacattaccctgaattgccttgttctgtgcaaactgacttgtaccagactgaataccttcttctactgtttcacgtagcatgttagaaccagcaccagccagcgaacctaccttaagtgggttaagttcaaatttggataccagaggaccagtagcagcagcaaccggagcagttaagccagcagcaatgatacccgtttcagatgcagtttggcgacgtgcttcatcaggagataaaccatcagcgatatgctgttgataaacaggagacttacttgccaattcttgatgggacatcttcatgatttcggaagcagtctgttggtatgcaccaccagcttccataccaccaattgcaatagcaggtgcagcaacacgaccagcagacaatgcaacctgtgcaggacgtgaacctaactcagcagctaaggtaatacccttaacagctttatcaccacctaccattactttaccgagtgcagatacaccacgaattaatggaccaccggtaaagagagaaccaacaccttcactcagcccatcagtagcagccataccattatcaagcgtattagcaacagaatcaaaagcatcacgaccaatacgagacagagaggcaaccaaactgctctctccatttttaatgtcttcttcgtagagtttctggttcttttgtgcagaaatctggttctgattctgaacaaccttacgggtagcattcagagcatcagactgtagattgtgtaccccttcattcagccaatccataccggaagcaatggatgccccggcattatcattgaccagacctgtgccaagagcagcaatgcccccaagggtattagcaacaccaagaccaacaccagaaagagtatcaccaaatgcttctgcgttagtacgttgtttagataagtcctgacgtacagcatcagcagcattagcccggctattaagaatctgtagaccttgctcattaccgtatttattaagaatttctaatggggaggcttgagtgaaatctgcctgaagtgaacctggttcgaatgcaccgattccaagattacctacacgaccagtttggagattgtaagcattctctggggttaattggaaagggctttgcccttgtgcagcttgcttctgagaggttgcagtagagacatcgacttgcttagcattagtgatgctgtctgcgaaacctgccagacggtcaaatgttgacatagcatgtttcctgttcaaacttatatcgtatatagaaagcttactctacagtaagccagtgtaagaaaaaagccccgaagggcttttgttagtattaccgattttgtcttggttgcatatactcaggcaaaccctgtgcctgacgtaaataccgtgcagcacgttcttcatcttccttggctcgtgctctgtccacactagcctgtgaccggaaacctcttggagccaggttagatgggtctgcttgaacttgtgcttgagcagcttgtagcattgcagcagctttagtaacagcttcctgacgagcaggcaacaatgcagtaagtcctgtttgtccggtgttaatcttgttctgggtatttgtcagtgcagctacagcagcatcataagcagtctgtgctgcctgaatattctgcatggcttgagcacgaccaaggttacgcacactgccttccagtggttcaccacgttgtacaccctcaattaactgatctaccagacggtcattaagacgcataccattaccagcttcattggtaatgaatgggttaaccgcatcaatagcacggctaatgtaaccttcaggtacaccagtctgtgcacgttgcataacagcagcagccatagctggagacatattcccacgttgagaaatatcagttaatcggttaagtacccagttacggtcagcacccttaaagtcaccatccagtagacgattagcaatctcacctactggagtattatcggtgacagtacccaggaaatcggtattaaggctaccggtattatcctgcatagagcgagtaccaatcataccctgagccaaggtagatactgcctgatttccctgattattctgaagcagagagaatgggtcagcccctacttcagcttgggcaataacaggtttaatctgttcccaagtcatatccttataagcacctggggtagagttaggtaaagcagcccaggtatctttaaggttaccattcttacgagcctcaaaaatagccctaccaatcttctcctggttctcaggggaaagaggttggttctgccaatctgaaccaagaactttgggggcaaagtctttcaaggtagcttggttaatctgaaatgcaccaacaggagaagcaccctggttcgacttcataccatcctgatgcttgattacatcaccgatactcatttgagtaataggagtggaagtaccagcaaactggtaagtaacatcataaggggaaccctgtcgagtaccagcagtaccaggagcagatgtagtacctacgccattaccgtatacacctgggtaagcattagccagtaatccttgcaaacgtgcctgagcaaccggagacaggttcctgctatatgcctctgccaacagacgtgcatcattgggattctcagcaccccgggtaatctgtgacattacacccatagctgcctgactatcagcatcattacgctgagacacacccaaatcaaaacggttctgtgcttggttaatagcctgaccaccttgaccttgaagacgtcccatcatctccagttgctggtcagcagggagtgcagatagtgcctcacgggtctgccccaatgcagcattaatacggttctggtcaccagactggtaggcctcggacagtaaacgaatagctggggaagcactatctaatgcagcatttgtatcctgtaaacgaccaaagagataagcattatagtcattggttccctgctgaccttgttgagtcagaagagtacctgctcgctcatccagattctgtagagtacgctggtttaccagtgaagggtcaaccccctgaaacagtgcaccagatgccaaagcattacgatactcagtagggtcttgatactgcatagcattcatcatgacggcattgccagcctcctgcttggcagcgttctggaaattacccagtgcatcacttaagccggaggtggcgttacctatcatgctaccaaatgtgcgaatgctgtcaccaactccagagaagttaggtgcatcaacattacgccatgtaatttgagccatgatggtttcctattaacgggttaatttattagctgcaatataagcatcagcagtagactggtcacggttctctgctgtagcacggctacgagcacgatcttccagtgcagtgttataagacttaatctggttattcaggttagtgttagtaacactcttagtaaagttcaactggtctttggctaacttattagcctggaaaccactgtagatattagctaatgaaccaagtgcacccagtcctaattggaaggtaggtacattcaatcccaactgatcagctgaaccagacaggaaagaagcagggtaggctactcctgtatttgcccccataccaatagttgcacctgggttatagttcatagccggggtattaaagttctgattgttattagacatccaagacatagcagctggctgtggagttgggttgcctgttaagaatgacaaatccatggggattctcctgttaaacaaggtcagtattaagagtcatatcagagtagttgccaaccatgtctaaagacaagtcagctatatctgaaccagtcatgagagtacgtgacaagaatgaatccaacgactccattgacacgaattgcatggggtcaatcacaccctgtccagcagtaccgaacatctcttcatactgcttattgattgccatcatatcagtattgtactgctgcattacactctctgctttctgaatagtagcagccgtggatgcattaatatactgactaatgccattacccactgaactggtaagttgcatgatgttttgagcactcatcatttcaccagctaaagaggataaggatgtaccagtagacaaagcagtaccaacgttcatggctaccattgaggcaatagcagcaatgataaaacctagcttatcaccgaacagtgaagtagatactttagtaataatggataccagaatcattgcagctatggcgtttgctacagcaccaactattacagcagctaatccaacaaaaccaagtgatgcaccgactgcaccgtatgccccaagtatacctgcaccaccagcacctgctgtaaatacagagacaactacagctaccactacaacaacaattttaaatgccccagtctgataccacttctgcttaaccttcttatatgagttcatcactaagtaggagcaggcagtggataactgagtgctacgaaccagtgacattgaacggtagatattggtgtgcagtggaataatgaatccactctcctctgcatcacccattgcttcggcaacatcaatgtgcactgacttatttttatataccctgttgttgtgatttagacccagtactctaagtttacgataggtattattaccatcctgccaaagcaactcgtattcctgcattgaatagaatgtgtatgttacctcaagtttcttagcagaaccggagttggaagctgtccttatgttcttacgagtaagggttatatctcctgcatacctggctcgaagttgcccctgcttagcaccagaccatgcttgacctgaatgggtagtttcagatacatagttccagccaatagtcatgtcgtacttgtactgcttattactatgcaccctaaactctcgcttaggtataactgggtattctggcagtggtggaggtgttccaataatatgcccttcagtcctgttccaccattccacatatgtgtcaactgcatcatttgctgcctgatagcctgcaatcactgcttccagtgttgggtaggttgggtcaggtgggaatgcttcagtagccatctgaaagaaacgatagatgtattccttagcactatcctcgggggtattaagggatacaccaaatgaaccatagatgtactgaatatcacctatgtcatcattcttcttaagctctgtgactactttatcaatttttccaccagtagctttataaagggctttcttacagtgtgggtagattgggtcattctctacccattgcttatcatttctgattggaatgaatgggtagaatcggttatcagtagcttcagtctcgaacaaagaatctagtgcaacgttaccggagttctgcttataaataagcattttaggtgtactaacagcagtcatctcggtatcagtacgggtagtctgggatgagtacttacgaaccagtgtctctgtggttgtagtgattgtatctgtacgagtaacacctccacctatatcaaccacattagtagttacagaagtactggattgaatctcaccaaattttgtatgagtcattaccctgtcagatacaactacagtcacatcatcaggtttctcagtgaatcctctacgataaactttaacgtaagagttccagttatccacacttggttctgtgacagtactgtcttcatccggtctgccatcagagtaaacagaatgagtatgtatagtcttagtaagattggttgtgttagccgtcgtatcacttgagacggtagtccataacaaagtggaaggtaagtcatcctcatcatcatagacagtagtcggtcctactaccggaggattagtagaaggggacttatagaatgagtaatcagcatagagatataaagcacctggttcaaagttagtaggtgtgaatgtaatagtagagcctccatctaaggaggtcatagtgatttcattagtatcttcatcaatatctatgtcgaatcgttccatgattcgacttggagcattctcataaagatactggtcacaccattgctcaaagtcagcaaagccaatctctgctgcctgaacatagactgattcaccagcagggggtgtaatttgaccctctataacggtagggtcaatcttagccaatacacccaatgaagaaccagccataccaactactgaatcatagtggttcttactccagctggagaacagtcgcatacgaatacctggcccattcagataactatcagagatagtatctgccatagtgaatcctgtattggaaacaatattacctataactacagtcttcatatagttagggcgtttatgtatatcccctgccatgttatagacagaggatgctacgtatactttggtcttcccactgaataagcccatattagttcagcccgttgttagacttcagcttggtcagaatggtgtcaatacttgcgttagtgaaaccatttggtggattcaagccttcatcaatagtcttctgagtaatccatgcatcagtaaacagcttagatgctttaacctctgcatcacgttgataagaagtaatctgttgtgagtacaactctttctgtttacctacagaaccagtaacagtagctccatcactacgggtatcaagtgtctgtgcacgttgtgcttcagtctgctcagtaagcaatttaagctgttgaggtaacatctgactaacattaaacaatgcagcacagtatgtttcagactcagtagcaatcttcatcttagtaagagcatactcactcttagcagacagtgcctgaatcttagccagcacaaactgtgctttaaacgttgccagttgaacacgagcagtaactgcctgaatctgtgccatagcagcagcccagtatgcctggtcacgaccaagtaagaactgaacagcattgctcatgcaagattccatcatagcaatgtatgctttggtatattcaccaccggtaatacggttagctttaaactcagctttcagatgattgtgtgcagattccattaatgcatcaaacgtaccactaccaccaacttcacgggtagtgagtgattcattggatattttatcaatagcaccaaagattggggaagcatccccaccagggatatcccattcggggccagtcatatcaacatcaggaagggtaaagtcatcacccttagttaactcttctaggagtcggttagcttctacctcagcagaacaagacataatcattcctcttggttcaaaaagaaacggcccacggagttaccccagtgagccgtgttgaactgtagcttatacgttaatcgttcaggctaccagcagcaatctgtgcctgagctagttgagctaattcagcttcagtcaacggaggcagtacctcaatggagaactctcgtgcttcagttgcacgaatatccggtaagccattcttacctttacgggtcgtaatgttgatgaacttacgctctttaaggaactcgtagatacaatacggaatgtgataaccattgtcggttacttcaccgaatggaacaaacttacgcacagtacccatatattcgttagctacggtgataatctcacctggcaggtctttcttcttagggtcaaggttctggatacgtacacgaatcagtcgagtctgttctgcacgaatcttttgaccaagagtcatcttcttaacaccagcttcctgtttttcacccagcggattaacggcagcttcttctactactggttcatcttttacttgtgcagcttcaatcttctcacgaagcttttcaacggaaatgttgttagagaacttgatattcatcaacgttgcacgttgcttaagaacttcaagttcgctaggcattgcaatatcgttaacggtatcttcgttgccctgtacgttcacttctacgtcagtggtcggtttatcgttaatgctcatgttcatatttcctgtggttcattcagttttattaagagggggacattagtcccccttgttttatttcggactattacagaggagcaacagtcttaatcatagccagacgttctgggcgtttaaccaggataccgtagtaccacttgatagaactgaagccagtttcaccatacgggtcattacggtcagcagtttctttaccaggcatcttagtcatgatggagaacttaacagacttaccatcagtctggaagccaatggtagagaaggagtcatcaccaactaccagcatcgggaatacgtcgtagtgttcctgaccaccaaccatagtagaacgatagcctgggttagaagtagcctgagcaccagcacctgcccaatgcagcatctcaggaacctggataatacggaacttgtcgatacaaccaacttcaccattcatcagagtaccggcatcagcatagtgctgaatttcgatgaatgctttgttaccgaacagatctttcatcgctttcagttctggaaccaattcagaaccaacgtacattacacgagtaccaccaagtactttggtatcagtcagtttagaaccagtgataatagtagtctgagtcggggtacggttctcagtaagaatctggtcaagacgcatcaggttcttataagaaactacagacggagtagaaccttcaccggtgatggtagcatcagaagtagcagcacctgcatacaatacagtaccagcagcagcaagcaggtctttctggagaacagcttcagtcagctgtacagcaccgttcatcaattcgcgagacaggtgttctttcagttgatcatcagaatcgaagtccagggactcttgggtaaattcgtagaagaaaccgaacttatggatggagccttcacgagacagacgggtaaagcctacacggttaacacgaccaccgttctctgtcagcagaggcagtttggaagtgatgttaccaacgtctttagaagaaccatacaggttaccattaacgatggtagcaccattagcatcaataccctggtcgttaatgttcttatcgtcgagcagaggaacgtactcatacaccttaacagtcttaccgtagttcttcggcatgttaatggtgttagccagtggcatgaagtactggtctttacgagactgaataatagctttcttcagccagtaaaaggtattcatctgatcggaaccagcaccatcaatgctagatttctgaccgtcaattggagcgttatagtttaacatatcgtattattcctgtttaaagactacccggtactgggagtttagcgaaatcttcatcactcatagcgagtgggtttacaataggtgttgctttgcgtgtagcagcccgattaagggaagctgctttagcttgctcactgttagccagagtctgcttaggttgtgctacacgcactaccggctgaactgctggtttaactgcttgtaccggctcaggcttagctacttggttaaatgctccctgttgtgcaaggaggttgccaacgtagttataagcctgaatgaacggagtacctaccggaatctgacctaacatctgaagacggttcacttcatttgcaatggtgtcataaataccattctcacgttgttcgtgaatcgtatggagtaagccacgattctgataaagagcatctttactggcagcatcccatgtcgagccaataacacctaatgtagcttgtccttcttgagtagactttaagtcgtcaatttcggttgcaaaatctgcttcggtgtcggtaacacggtgattgccaccctggtagttaatttcctcatctgggttaaaatccagagggtctgtaccagagtctttgagcaacttcttaatggcctcaggattcttcttatccaggtcaatcaggaaagagagtttgtcctcatccattaaaccgttgttctgtaacatcagcattaccttacggtacggctgaagttcttgcatcttacgagtatagttagcacccatctgcatcaggctaatggcctcctccggtgaacggggagtaatcattttgccgttagctttaaaaggagccatcaacttctcataaccttccttatagttgaagtcagcaggcagaccttcagactgtttgccttcttctttctgttcctggccgggttcagtagtagaaggttcagctttagtaatcggcttaccgttactatcaacttctgtgtcaacaactttatcatcaactttatcagaagttaaagaatttgctgcatcttcttcaactggttcggtttcaggggaggtttcttcggttggtaggtcttcaacagcagaggtgtcaacttcttcatcaggagtctgtacgccgttggtttctgggttgttctgagtggaagtatcttcctcagcgataactgctggggcttccatattcagaatctcatcatccgacattgcgagaatgtcggaagctgtggttgcagcttccgtagtcataggaaatatctccggttaattattcatcttcaggttcagcacgaactgcatcgagttcttcttctacctgaagaataacgtcagcttcgttttcgcccatacgaatggcgaggtcgagccaacgacgtaagtgaccagcagcttgagccatgttaagtgcatctgcacggttatttggttcaagcagtgggtcaccagactcctgcacgtaacgtgcacaatcttctacacagaactggcgaagaattactttacggaacagtggattctccagaagtttacgtacatcttctgcgtgtgcaactgcacctttagcagcttccagtcgatgttccagtccagcgattgttgattctttactcatgtgaaggtctgccttacaagttcatgccaagagccgatgctgggtcttggctagggtcatagaattgggaactaagtgaataagctgggtcttgttgtgcagctaagtcacgttctggtatagagttcccgttagtcaaagcgttatatccaacagcagcagatatgttgggggtagtttcaccttctttagtaggtgttgtcaacgccttagttatctgaaggttttggtttccttgggattgtgctttttgtttttccatatcacgagcatgtttagtaccagattcctgttccagataatccaggtctttaaggtcaccactagaagcagcttctttagctttagcattattgagtgcaatcttactttgtaactcttcattctcaagctgtgctttctgaattgccaattgcttaagctgttcttccatagggtctggttgtggttgccaagtacgtaactcatgagcaaggtctggcatacgtttaagttctgcaatcttagctacaagagataacgtaatagactggtcaactgtgttgcctagtgtttgaaccatgaagcccaaatcctgggacttctggttatcaatttcagcagtgttaatatcaacctcaatgtcgaagttacctttaaggtcttcacggttaatctctacatactgttcgttagtaatacgtactacttccttctctgataagaacacagcattcattgcacaaatcttagtaccaatgtctgccatacccttagctaatcgacgaaggattgccatctcacgtttagatgctgcatcaagtgcaccacgaatgccagcagcaacatctccgtaagctgaaccagttacgccgccagagaatgctttaacacctgttagagcttctgcttcctggttttgcatctgagtcattactattgcagactgaggcaactcagggaacttgtgttccataatagactggctaggatttccctgcatcggattatattcatagtcttgcccatcatcatatcgacgacggttcagagtatctaacatccctttaggataaccacgctgaccatttgcacttcggcctaacaggtcaatcattccacgaatagttgcaccaaggattgcttggttatctcccaacagttcagcatcagcttcaccgtaaagttcacgtttacggggcatgtagggaacaactactaatggtaacttgccatcagggaatgggttcttctccatacgaataagagtagaaccaatccaggtagcaacaattggttccagtgaaccatcatcattaatgtcatagaatccccagtactcataagcaactactttcttacgaagtgcatccttaaactggaagtcaccaggagttttgctttcatggtctgggtcagtaatgggactggaactctcccagtcaatcttatccagattgtgataacggtctttgtttttcataaggtctgctttgcaagtctcaaaggagataactgcatacagagccttatccaaatcaccattacagcttgggtcaataactacgttattagggttaagcatctcaacggtaggtctgttaaccagtgctttttctacttctacttcagtgacccctgtctgaattgcataagtagcttctccagtttcattgaagtagttaacagcttctttgatatcttctggcattgtttcgtcatactcacggggattctctgcctgaagctgcaaagcctgttggagaacatctgcttgttcctggttctcaattggatacaactggaagactggagtttctgttttaatcttaatagtcttacgttcccaaccgatacgagcaataccagtaccgtcatctacgacactatgcacgtaatcatctaccagttttactttattaagctgagtacggaattggtagttaagaactagctcattctggcgtgcagctaactcatcttcaaaagtaaccggagttaccttaaatagtttgttagacgagaggaatggttcagacaatggagcataacgccactctgcctgacggcgaaccagtctaggctggacttgcgagcgtcccttaacctttgggggtttagccttaccctttacttccattaaatcattccactcacgaatctgtgccatgattgcatcgtgagcaggtttagcagattccaaatcacccttcagtaattggatacttggttccttcttccagtccgttaacttctctgattgagccgggtctggtaaaggcttaaaagtgtcttggtgttccatagttattcctgttcaaaaagtttacggtcagcctgaatctgtttacccaactcaattagttggctgtcacggagtctaacagttgcccggagttcttcaaccaaacgtctgccttcttcaagactattgtcgagtctggctgcatggcttgcaagacttctgcactcaagggttccggcttcggcttgacgtttatataccgatgctcgtctttcagactgttgcatccggctgtcgtaatcactgctaacgcgagcaagctcgcttgcgtaattactctcagccgtctgcaaccgggaagtgagtaacccgacttcataactatggtttctttggagagcattgtatttgtcctgtaatttttgcgttgccttttggtcttcgaccttttgggcatcccatttcttttgaacagtagactgcccattggaattgccccaaaagtaaatggtggccccaaggaccaccaccagaagataaggccaacctttagagattagcatcttcattacatgcctccagtggcacattgcctattcggttagctacccaaccatacgtaaagtctggcatgtttaatgaggtatagtggttcagttgtttagcatcaagcagcttaatcattacctgacatgctgcaactttgccccgttttttctgtaatgctttatatgcattaacagtacttgtaccgactttaccatcaacctgtattttagggtagtctttgccattacgtgacatttcattaagagacatctgcaaccacttagcaggacgggttacaccagtattaacaccagcatctactagcttatgcgttacagcaggagatatatcagcgaaggctacgaagttaggtttaagtacatagtcatcaatgtatatctcagcagccatctctttagataaacccttcatagaaccatcccaaccatactcagtagccagaacttctttatgagtcttagctactgattgggtaataccatgattagtttccccacctgggtcacgaggattgtttacataacctccttccatatagaacactgcccccagaatagcagcgataacccctcccactgcaccaccttttgcagcaagtttctgtttagctttcatgtgaatcttcctttggtcggaatcgtattaatctgcctatgatgtttaaggcaaacagtgcgattgcaatattggaaccatggggaatatcttccaagatgtgacgaggtaatcctgtcaccattggttggatgatatctacagcagagaatagaattaaaccaaacgtactaatttgaatggatgcccatttccagcatcttttccagttaggtactaactctacttttctttttagcctgcgaaccatgcgaatatctcccgtcttgcagcagccaatacaccaataattgcacctgctccagcccatacccacttaccaaaaattccagcaccaacaactttatgcttaatggtgatgaactcttcaatagtaggttcattcttagctaagctatcctccacattttttagtctattgcctatgtcattgattgaatcccgtaattctcccagagtttcctccagtttctcacggtcctgtctgtctctcgtctgattctcaaacagagtcttcaatcgttcctccagtctgactagaagcagttcgcccgattcattcataatattaccgtagttgtaaagttaagaaccccaatagggtcgtatcataagatgactcttagataatacttagtatgatgggatacatccagacatagtgtctggtatcaactgcgaggtaactatgtctattaaagatattttccaaagtggtaaggatgttgtgtgcaaaatgaaggggggattgttggtcgtgggaagttatggggaacgaatagtttctgctaataacatctcagagatccccccagaactactacctttcccaccaacagagttagaagacacattccttctggacttgtatacatggaccgggagccaggcagtaaatgaccaatcctggttcaattacttttcattaccagggataactaaatcacctggaggtacagcagcactaacaattgaagaaggaaatcttaagttccccattagaaccaggaatacccaggtaatgttcagtgttcgtatatcaggaattattgcaggtggtgcaggtacagcaagggaatggagaacacaaacaagacgaaccaatggaattacgatagtaggttcagatgctagtgttaaagtacagggtacagacattgctaacagagataacgtactggctacttacacacttggttcaactgaccctttcatggtagacggtattcagttaggtatgtttaatatctcaggacaagtaattaccctaacagcagtatcaattagggcaatgcaaacagtaaactctatataagaaatattattaatagataaaaacaaaccccgcctgagcggggttttatacctagataagtaatagcctggtagtacgtaggctactgttaaccaactctactgatctaaccgtaccagtattactcacttagacataacagctaatgcttcctgcatacgcttaatagtacgccgcaatcaacgcagcctctaatatcagtacttcctcgtaacgaataccgtagcgggaacctgctggtgtaatcagtttacgagagccattggcatcttcctcgtatacatcatcccaactgtcgaagcacaggaagccatagcgatgtgcatctataccgtgacgttcgaatgcctccttagctcgctgagcgatgatgccgaagtgccatctagctgagtctgcacccttctcctcaattcggtccaagtactgaaattgcacaaagtcaacttcagaccaagcatccagtaaagcatctgagataataagaggctctgttttatccctagcatctgagataacagtgaatgctgattgagtaaaaccgccagaccatgctcgacttgcggaacctaatgcgtatgtatcagtactatctggggtcattgcattagaacctaactgcaaataacctgtgctactggtaggaagacgcacgttaccgttggtgagtgatactgtccgagaagtaccatcagaagtaaataggcgaacttgagaagaagtacccccacctacagctaatgacacagcaccatccccaagcattctgtacttatcagccgaggtaagaacgcctgacggaagtgacatggacttaatccgccattcgaacctaccggacatactgcctatgtactgtcctaatgcaggagcgtgcactacgttactattactagtgccgtcaatagtaactgcaccttcaatagtaccagtagcactgagaaggtcgtttctccttcccggatgctttacctctacgaagttacgggtagaacctgattcgaaagtaataacacctgtagcactgtagctaggaaatacagacgcatagttgttattagctgtatctataaagcgcgcaattgtagcagtttgagcttgccctaaagagttagtaccatcacatcctgacataagcacattgcttattacgttatcagagccttctactgtaacaccgtgagcctgactagcgtcagagattgagaaatctacaagcacatctgagattaagttggtactacctttgcctgcaacaaccgctgcatatttaggattattagccactaccccattgataaggttgttagagggagctattgacccttctgtaccgttgtaagttacatgctggcagtctgcccctataacattgctgactatgttataactggctgtacctttcagttctacagccccgaactgagggtagttcttagcaatgacgttatttatgagggagttaaccgaggaatcagcaagtatgcatccagccgccttattagtagcatagccggagtagctacctcgaatgcctttaatcataagcccatcagagggtgcatcattagggtatgtgattaaactgaaaccagcgcccttaacgtttgagaaattaacatcacttatagtaacatcactgccaccagcaagagatacctgctgcccttgagtggtatcggtcgccttattactttctaccgtaatattacttaagcgacctgagcgtagattgttaaatactaagtagttacctgtacttgaacggtgacttagtacaccactgcctctaccgtctaagttacagtaattactattaataccagaactagagaatacaccgtctgatgctacgacagctttttgagaatttagtgaagcagctatattctccgtactatctgttacaccatcccctttagcaccccagcctcgaacatcaccctcatcacgccatcttgccatctgcaattcagggtaactggacgcaccatccgggtctgaaatctggctgcgcagggctgcatcaccgacgctcagccactttcctgtaccaatatcaggaacagacccagcatctacaacctttggcagtgcgccatcccatcgatacaacccaccctggtattcaagacattcattctttactttaatctcataacccaaagagaaggacccagggactgttataaactctcctcgtgaaacagctagtgcacccaggtcaacattaccagtagagtgaactaacacaccggcagtattaaggcttacagcagtaacccctgaaccaaggtctgcaggtaatgagtaagctcgctgggtagtcttatcataaatgaccttgtattcccctaagtctacacctacagcaaagtaaacaacctcattctgcttaacaccaaacttacgggcaatggcttgtttgttggtaagaataccagtggagcctttaccaccttgtgagaacatttcgttcataagaacctctttgtttttctggttaatggcgtccttgccgaatatatccttatgtacacattggaagattatttaaatttttccaattgccgacgaagaaatgcacacttaagtacgggagatttctcataactaataccgtatccacccctccaccaacttaatggcaaaatggttttgtttattacttctgttcaagagcagaaagtctggcttcgattctttccagttttcttctctgataagcggcttcagcaaagaaaattccgtcaggccgaacaccccactcctcaccctcttcatgaataaccacctcggtgtatacaggttcttccgtagtagtgacattaccctcctcgtcagtgtgttcaacgatttcattgtgtgaaaataccgtatcggtcatccgtggatacttgtcatagcacagaacagcataacgacaattcgtactgttttcatccatcagaccatgtgcaatgaatacatcacgaatttgttgagcaataaccccgaagtgaatacgagcatcattgcctttcagttgaacagcatctaaccactggtacatgatgtagtgaacgtcaccccaggcatccaggaaagcatcatcaaaaactaccggctctgttttcttctctccgttagaagtaacaatagggttacttccgaggtatgcagtggtgaaacggttacttggtccaccaagcgcaatgacgttatcgttataaggcttaacatcagcaccctgaaacagatgttcatttccgttgtaaactatcctgcgagaagctgtgttgctcgcaccgtaaagcgtaatctgtgcaccagtagaagaactggttccgtctcccccgcaaaatatgatgcgctgccctgctgggttattagtcggtacagatttcccgataaacccatactcaccttccattaaaacttcagagcgaatgttactactggtgctggctctaagggtcacatgacctaaacccaaatctcctgtaaattccattggagcaggaacagtgcgaatcccatttgtatcaaaaaacacggggacagctctgtcaggtacagcaccatatctgaaatccctggaaacacgattgtctgaaccaatcttcattttgtagcaatacaaatctgatggatgaccatctgatttgaatgggtctttcgatgagttatctccatatgtccaggggttcagatggtcttccccaccgaacaagtaatagatataactatccttaacgaccactgagccaacaccaacgccagagttgacaatgccaccctgataaatctggtcagtgatatttacccattgagtattatccaggttccaggtgtctaggttcactcgcgtgtaaaacgttcgcgggtaagaactgaaatatcgctggtcgggtgcgtttgcttcccactcgttgtccgcacgttctgttccaaaaagaatgagttcgtttcctaccttagcgaatggcagggtggagtggtggacattattcgggaacctcaatgattgccaggatatacccaaatcgttactacgatgtagtgaactacccagacgatccgaccgagttccacgggttacaacataaagaacaccgtcaaaatatttaacacagggttctgccgcatctggctcatattcagcagggatacgtcgttttatataatgcccaggattgttaaatgcatccgggaaatacagcataccaacttcacgtggagcagcatcaccctggtgatatcccatcataaatgaatcattattgatggcggtaaaactgtgaacctcggtaaccatgggaatcagtccaaggttggttttacgccaaggtgactggtggaacgatgtccccatatgccagactttggtagagttattttggtcagattcctgttgatttggcgtggtgacagtaaatgtgttgcggtcaataactgaagttacagtcatattccccgaaacaccagtcaccccagagttcgagaagttaacaaaatctccggcaaacaatccatggtcaggaatagtaattacagccacaggctgattagcggcttttgtgataccacctgtcggatggtaattacgggacataggacggtcccatatctcacaggtcaccagtgcgttagatgctaaagtacgtgtctcaatcatcgcaaagagacgattacgcatcacccccatactcatacagtggtagttaactgtcgggtaatcaggatgtaggtcggttaaccattccggcgttgtccaggtctgtccgtcatcccctgaacgaacccaggatacatgcagcctgctgaccccatgtctatcactagccatgaacgggcagtaaataacatcatcgtaaacgaacgctttatcctgtggccacgcattgtaataaggggtgtccgttattttgaaaagctcgccctgaacaaattcttcagaggcataataaagcggctgaccaggaatacgctcataaacaaaacgagtgttgacgaatcgactaatatcaggcaaggatgtgaccttatatgtcttcccattgccattaatcttttgtccaactggtgtgtcgtttaatacgttcgttaatgctactgtatcatcatgcacagcgtcccctttaacaccccaaccacggacatctccctgattacgccatagggtattttggtcagtttcttttttggttagtaactcaacctgaatgttacctggagtatatgtaaggatattaccaactacgctggatatatacacattagttggtaattctggaataacgtaaatctgctgattatcgggattataaataacttttttgttatttaaggattgtactgtattagtactgagaataacctcagaatcttttacattagccgcacgagccacttcctgtagagtacgatctgttgcttccaatactcgtgcttcaccaccaatctgtactatcaaacgatcattggttgtcagtggttcggtaagaaaaatacgttggttatctgggtcagcagtataagactcagtagttaatcctttatacaaacgaagaccattcttatacacagccggaatagactggaaggtatacggaatagcaataacctgctcaccccctacagcagcaccattgttgtacaaccaattgatctgaatccagtcattaatgttaggattatccggtacagcaggaacaccagtcagaaggaatactacttcatctccttcctctaaaggttgagccagagttacggacaggctgtctacgttgaactcaaatccacgacctacatactgcatgtcgccattaacaataatgaaaggtacacccaccgtaccatctggtacgttgattgtggtttccccaccagtagcagaaccattactgtatacccaaggaatataagcaccttcactggaagaagtaccaccaccattggaaccagaagtagcaacagtaatccacgaaccagttgcttctgagtcatctgggatgatgccagtacgatcaccttctacgtacaagtaatcagttacctgccggtcacctgcacgggagaaaccgtagatacgggaatatttaacctgcgtggataatgccttcaattcctcttcagagtttacaccgatgaccatcccatactggttcaggaaatcatacaggagtttaagattacccaggttgcagtacacagtacgaaccacatggtaagcattaccaagcagtgcatccaccatttggtcattggaactgctatgacaatatggattggtccaatcctgatttgcatcaaagggggtatgtgcgttcatcgccatcctcgttgttcaaatttagtttcggtaattgaaatacttccattagccaggtcgtaatcaacaacctcaccacagatgctttcatatgtttgcagatgctctgctgctttagcgttagcttccggagtattcaaaccggtgtggtaacgataacccacccagttatgaagtgccgtcattagcgtatcagctaaatcaacttcctgttcttcatcacccgtaagcactgggtgcttggcttgatacattacgttaagtgcctcaaagtgtcgaggacgcatacactgaatagtatcaggccgtggagtgaagatagcacgagggtccgaatcatcgttcagtctacgtcggttccctgagttatcaaatacatttaagattttaataacatcatcctggaaaggtttcatgaacccatccatgatgtatggatactgaacctcaagagtgggcttagtaaatctggagtaagcatatctggattgaagaggataatcggtacgcccttctttcatctccacaatacaactattagttctgagagggaaacgactatgcagtcgaaccaatccttcattaatagctgccagtatctcaggcttactatcaggctcaatacacaatctgtcatccgtgactgcaccagtacccttcaaggtacttagtgccaagccacggtatacttccgataatttttgcatggttcctcacacaatatatgaacgtagggggttaacactatcttcttcttcatcgtcccacatcgggtcacccttgttatccaccatagtcatacctgcctgtggtttccagggattgagataacccagcatagagatagtatcaatacagtcatccttacctttgattccattaatggtagctaatttaatctggcccatgaacaaacccataatagttgaatctctcaactcttccgggaagtacatcttaccagctttgaaccatggaactacctggttaaagcgtgacagcttagaggttacaggacgtatgcctggcttaccaccttcagaggatgcaaagttaaagaagacattacggttaatcatttctttttgaaggagtgagatgaatccaccttgttgacctgtggtttcgaccccaacattttgtggttggtattcctgaaccagacggaataagtcatcaaagtttttatccataagctgacgattagccacaccatcaacccagaaccaatctccattagaactataagcccaaactgaaatgacactgtagtcactggtctgtttctccgaagtagcaaagtcagttgtaatgtaatagttgtagcaggacttcatccttaatagttgttgtctgctataccacctaatttcactatcctgaaccagtctctcatcttcagaactaatacgaagcataagttcctgatagaagccagccaacttaccagtcttaactgccatatcgtattgagctttgatgtagtcatatgagaaacggtcatcccatgcaccctgaaattcttccctgctacaggggaacttctcgcatacaggccatacgttgacatcccatgcaccagactcaactgcttcaatgataatgtcttccttattaaagggagtaccattgaaaattactttacgacgggttgggtcaagagcatggttcacacctttatagacggtatccttaatagcttccatgcttgtcttggagttagcatcaccatcgctaatcaagtcatccagtacacagagtgttggacgtttaccatatatcttcgtaccacgaagacctgtcttagcaccaaacaacttaacaccaagtcgatgtccttctacattacggaactccagaaggttatctgtaaatgtagcctcaggtatccattgctgaaggaactcactattcttgtaacggaactcaatgttcttacgtgcagacttagcaccgttatccattgagtcagatacgtaaatcattccttctaccttacccaggcttggtaaatgaccaaacactgccaggaacaaagtaaagtactccatgaatacagcagttttacctgcaccacggaaacacaggttaactacatactggttcggactaatcatcttatccagcatcttcaagtgaactggaggtgttttgttagattcaccctccttaccattaaccaacttaataaagttggcaaaggtaagagcaaactgactaggaacatagttagaagaattaaggtgggagtaatccacctggtctagccattcatctagttcctgtttaattaattcagacatttgtaatgtcctcatctgcacgtactagtttagaaccagcaacctctttggtaggtacaccactattgattgcattgatttgctgttcagctaatgcagcaagtgttgccttgaggtcagttaacccggagttctctcttaagtccagattgatattcgttacctggtctttcggtttagccaagtgagtaaggatagagttagctgcatcacatcttactttctcacttgctgctgtggtcattagttcaacctgaacgttgatagccttttgataattgtcctggttcacaatccacactggaaccaaactttgttccatgatgaggttaaccaatttacccctatggtaagcagatacataagcactgatatctttctcactggttcctcgtgctacaagttctgcttgtcggttagggaatgtcttaaagtaggcttccttatttgagtagcccatgtgtttgtaagtcacatactgaactgcattcatgtagtcctgtgtcttaaacttaccttccttcataactccagagtaagagatgaagttttcacggaatgcttcagcaaccagttggtcttgggtaatgttgttaattgtgtccaccaactcctgggttacactgttcttgaagttagcaggtagggcattaacaatctgctgcttagttagttcactcatacttatctcgctacaaagttatgtctattaaagaagattcttttcttggggtgagttaccccttgaagaaaccataccatacagttacactttagtcatgatatagaaaaagttcatgatactaaatagtatgtaatgttccgatgaccctattcctaaaaggagtaacatttgagaatctatatgagagtccacgactccaaagatgaatacaaagaactagaccataccaaggctggtattctttcagatgatattatcattacacatgatgaagattcctaccatgaattagctgggatgatgctattagagaatcgtccaggcattaagatcttagaaccaagagaaacttactctttagaaaagagactttcagctcttgtgttcttcacaaaattacctcatagtgtctccgtcaggcgaagcaaagatagtgttcggatgatggtgacgatgtgattagtcatgccgcctagtagacagtggcggtactcgtaaagagttaataacttctacagtcagggttacccggctcctttcctacctagtaggctaacgatacacatgtatctagggtgatgaactgacccgtgattgaaaacggtaaggggtagagtcgagaggctctaccccatttctttttcaggaggtatgcaaatatgagcatctacgcttttgatattgatattactgggatacttcgtaatcaagaaccttattaccttggggaaccagaagtagtaagtaagttcattaccccatggcaaacagtattcttacctgactgtgaagagtcacacgaggttattggttctcttttcctatccaacctgcaactcaatactaagatactcactgaaccaaaggtgtatgacctctccttttacagcgactttagtatgattttccctggtgttaggttctataaaatacctggttgggaattgatagctgaccataatgtctttaataaaacactttccatttacttcagacctattcctaaaggaaggaaaattaatcatgaaattcataatgaccatccccagttttgctgaaagagaatctatgtatacaactgacttctctttagaagaagtaatgaacagcaacccccagcaagtaatcctggttcctaccttagaggactaccatgaagtaaggggacagctattcttagcaggtaatgatcgtaaggttgtatgtattattccaccctctgtctataccaactacagtgcaggtgaccctatcccatatatgttggtatctaatgactaccaatgggatagtcggtatgtaaatgatgaatactgttactactatataaggaagtaagatatgcatctgtattgccttattagctttgctactacttgctatttgtctccatatacattggataatatcctggcaggtaaggggagagttaccaccatcctgtatgagccaagtgaagatgcagatgtgctcataggtacttgcttaatgttggggcaacctatccaattcattaagatagtagattccgtagaaataccggaacacaccagtgtgtacatattgtcagagagtgaacctatggtagtaactacccttactggtagacttattaccctctatccttctacctcatatttatctagcgacgagagtctctaatgaaactaaacacatcaccctacccggtacagttagaagtagtattcgaccaggataccttcattaaaaagtataagaaacttaaagggcatgagccagacttggatggttgtaaggggtatacttcttattctggcaatcgagtattgattggtatctttagggaacctttacatacactcatccacgaactcaaccatttctgtttgtgggcgtttgactacataggtatgcctataaactctgccaatagtgaagcatattgctattactatgaccacatcctctcccagattccttcctcctatttaactgcttataaggattagcatgagattatatttcctatcagatatgggaaggttacatgtaggagagggtatactatggaattggatatgtaacaatattcccaatgtacctgtatatgttcactccgatatagactatcactggttaagaggcgagtgcttacttagaaatatgatagttaacttcataaaactagaaccatgggatagggtatccgatgtatctggcccatgctacttcttagcagttaatgggcatagagcagagaagatgttatatagaactaaatagagggtagatagataccttctcataatatttataaataaggcagaaccggtgacaagagtacaatacctatgaatcctatagcgaaggcacaggcaataaagtgaagccagttctcagggtctgtaggattgtaattaccccaaccatctttcatgttagtaccccaaagttatctgcttatagagatagtgcctataatatttttgcatgtcaaaattgtgatagctatatacagcagcagtgttg

SEQ ID NO: 20 - DNA, 43963 bp, Unknown
  Podoviridae; Autographivirinae
tctgttcgtttcgttcactccgcttgcgctacgttcactcgctcacgggtaccttaggttattccttgatggatggcttaggttagccttagtggcctaccttagttataaccttagtgcatagcttagtatcagcttagtagtgtaccttagtaagtcttagtgtcttctcttagtgattgcacatgcaagcatgtaagatgccattaggtcgcggtcggtagaccgctaaagaaagagaatagtaataagatgcagtaggaggaacaccagaagcctagccaacctaagctatcctagccttgtatctattgcttttccttagtctcacatgttagacaacctatcttattcttagtgatgataacttagtgttgacaagataatcttagtgtaatactatgcatcacgtaggcggtgctgaagcacctagtagccagctagtaaggcatacgaagagactagcgcttacattgctctttaacaatttgcttagtgtaacctatgtatgccgtggtcaactacttattgaatgaggaattaactatgacattaaacaaccgtgaactgtccgttctcttcactctgttgtgctacatgattcgtaacaacgaattacttacagacgatgagttagccttgtatcaccgctttcttaacgaaggttggaccgatacagttaatcaataccgtaacatgatagatgagttgagggagggtaaataatgtatcagcatgaggttttctttgagtcagccagtgaagctatccgcttccatgatgatatgatgcaagctggcgtaggtgttgatgtatatcactatttgatagattacgacactgaatatcaccgagttaccttagtatctgagtatgacaaccaagtcattactgagtatctaggcagtgaagattacgattacgatgaagtaataacgacaaatctctaaattaactgttgacagccacggcatacaaggttacattaagcatcaagacggcgacgtctttaaacatcccgctctttaacaatacggtttgtgtcttgataggctaactaactaactaaggtaattatcatgaaagggttaatttgtgtagaacgtatggtcaatggtaaacttgaaatattaccactggaaaaccaatctagcttcaaagagtggtatggctgtttctcactgatttaaggtaaaggctggcactagtcagcctatcaaggcgcaaaccaagctctttaacaatttggatggtagcttcttagtctggataggttaaacctaggagattctcttgagtctcctataatgtaacctaactaactaaatgaggattaaatcatggaacgcaatgctaacgcttactacaaccttctggctgcaactgttgaagcattcaacgagcgtattcagtttgatgagattcgcgaaggtgatgattactctgatgcactacatgaggttgtagacagcaatgttccagtttattacagcgaaatctttacagtgatggctgctgatggtattgatgttgattttgaggatgctggtttgattcctgacacgaaggatgtaaccaagattctacaagctcgcatctatgaagctctttataatgatgtaccaaatgacagcgatgtagtttggtgtgaaggcgaagaagaggaagaataaggatggaaaagcaatataactttatcttttcagacggtgtaaccctgaagtgttccctacgattcgcacaaattcgtgaggaagtactaggcactacatacaaactatttagctgacactataagagaaggcttaacaaggcgttactaaggtagcgcctgattaaactttcacttactaggagttgagattatgaaaaccttgattggatgcttcttgttggcttctcttgctctggcatttaccgctaaagctggttatgatgcttataaagtagaacaagcccagcaagactgggccaaaaagttcaacttgtgcagcaagagcaacacctacgagtactgcaacaaaacactaagacacttatggaaagagtaactagcctatagcccacctgagtgggctatgtgatatttacttaccactatataaggcgattactatgactactgaaaacaccctcgtgtctgtccgtgaagctgcaaccgctgaaatcaagcaacatttagacaatatcggcacttcttacatcaaagtaggggcttgtctgaatgagttacgcggagactttgaaggtcaaaaagagtttttagcctatgttgaagcagagtttgccattaagaaggcacaatgttacaagctgatgagtgtagcccgtgtctttgaaggcgatgatcgctttaaaggcgtggcgatgcgtgtaatgctggcgcttgttcctttcgctgatgaaaatataatcatggagaaggccgcagaactcgccgcaaatggcaagctggacactaatgccgtaaacgccctgattgaacctaagaaagagtcaaaggccgaaacggtacaatctaaggctgagacagtaaaaccgcaggagaacgcgactgagtccgcagaatcacatgaaatgcaagcgccgcaggtagtgccacccgcgagcgagcaggagtccgacgaatcagcaccttgggaagaggaaagcaaaccggaagcgccaaaggcagctccgatggataacacggctaatactgagaatgccgctattgctggtctgctggcacaaattaaagcactgactgagcaattacaggcagccaatgaccgcatcgcctccttaagtagcgcacgcgaaagcaagaaggcatccgcacctatgctgccgcagttcaaatcttcctgcttctacgctcgcttaggcttgagcgcggaggaggcaacgaagaaaacagcagttaacaaggcacgccgcgaactggttaagctgggatacggtgaaggccatgaggcatggcccttaatctctgaggcagtagaagagttgactaagtaaccttatcggtggcatcttcttaggtgtcacctattaaggtttctttcactaggagtaaacaagatgcaagacctacacgctattcaacttcaacttgaagaagaaatgtttaacggcggtatccgtcgctttgaagcggaccaacaacgccagattgcatccggtaatgaatcagacacggcatggaatcgccgcttattgtccgagttaatcgcgccaatggctgaaggtattcaggcatacaaggaagagtatgaaggtaaaagaggccgtgcaccgcgtgcattagctttcattaactgcgtagaaaacgaagtggcagcatatatcacgatgaaaatcgttatggatatgctgaacacggatgtaaccttgcaggctatagccatgaatgtagctgaccgcattgaggaccaagtacgttttagcaagctggaaggtcacgccgccaaatactttgaaaaagttaagaagtcacttaaggcaagtaagactaaatcatatcgccatgcgcacaacgtagcggtagtggctgagaagtcagtagctgaccgtgacgctgatttctcccgctgggaggcatggcctaaagacacattactgcaaattgggatgaccttgcttgaaatcttagagaatagcgtgttcttcaacgggcaacctgtcttcctccgcaccttgcgcactaatggtggcaagcatggtgtttactacttacagaccagtgagcacgtaggggagtggattacagcatttaaagaacatgtagcgcaacttagtccagcatatgctccttgcgtcatccctccgcgtccgtgggtatcaccttttaacggcggtttccacactgagaaagtagcaagccgtattcgtctggtaaaaggaaaccgcgaacacgtccgcaagctgaccaaaaagcaaatgccagcggtttacaaggctgttaacgctttgcaggcgactaagtggcaggttaataaagaggttttacaggttgtggaggacgttatacgtctagacctcggctatggtgtaccttcctttaaaccactcatcgaccgtgagaacaagccagctaatccggtgccgttagagttccagcacctgcgaggccgtgaactgaaagaaatgcttacgccggaacaatggcaagcctttatcaactggaaaggtgaatgtactaagctgtacaccgctgaaactaagcgcggaagcaaatcggcggcaaccgttcgcatggttggtcaggcccgtaaatatagccagttcgacgcaatctacttcgtgtatgcactggacagccgcagccgcgtctacgcgcaatctagcacactctcaccgcaatcaaatgacttgggcaaggccttgctccgttttaccgaagggcagcgtcttgatagcgctgaggcgcttaagtggtttttggtgaacggggctaataactggggttgggataagaaaacttttgacgtgcgcaccgctaacgtgctggatagcgaatttcaagacatgtgccgcgacattgcagcggatccgctgaccttcactcaatgggtaaatgccgactccccttacggcttccttgcatggtgctttgaatatgcgcgttatctggatgcactggatgaaggcacgcaagaccaattcatgacgcacctcccagtccatcaagatggtagttgttctggtatccagcactacagtgctatgctacgcgatgcagtaggtgcgaaagcagtaaaccttaagccctctgactctcctcaagatatttatggtgccgttgcgcaggtagtaattcagaagaattatgcatacatgaatgcagaggatgcggaaaccttcacttctggcagcgtgactttaacaggtgcagaactgcgtagcatggctagtgcgtgggatatgataggaatcactcgcggcctgaccaaaaagcccgtaatgacactaccttatggcagcacacgtctaacctgccgtgaatcagtgattgattatatcgttgatttggaagaaaaagaggcccaacgggctattgcggaagggcgtaccgccaatcctgtacacccttttgataatgaccgtaaagacagcctgacacctagcgcagcttataactatatgacagctttaatctggccttctatttcggaagtggttaaagctcctatagtggcaatgaaaatgattcgtcagcttgcccgtttcgcagctaaaaggaatgaaggcttagagtacaccctgcctactggcttcatcttgcaacaaaagattatggctactgatatgctccgcgtatctacttgcttgatgggagaaatcaagatgagtctacagattgaaacggacgtagtggatgaaacggctatgatgggcgctgctgctcctaactttgtgcatggtcatgatgccagccaccttatcctaacagtctgcgaccttgttgataaagggattacatctatcgcagttattcatgactcttttggcactcatgcaggccgtacagccgaccttcgtgatagcttaagggcagaaatggtgaagatgtatcaaggccgtaatgcactgcaaagcctgctagatgagcacgaagaacgctggttagttgataccggaatacaagtaccagagcaaggggagtttgaccttaacgaaatcttagtttcagactattgcttcgcataatattaataggccattccttcgggagtggcctttcttttacctactacctgtaacatttcattaacataaagtgtctcacatgtgagacttatttaccggacactataggatagccgtcggagacgggaaagaaagggaagataaagggtataaaggaagtaataggtattaaaggttatataggttatataggaatacctattaccttcttccttcctcttattaccacttagaggaagggcagacctaggttgtctcacatgtgagacttcgtatttaccggacagtatagataagattaactcactttggagatttaaccatgcgtaactttgagaagatggcccgtaaagctaaccgttttgacatggaagaagggcagaagaaaggcaagaagctgaataaacctgtccgtgaccgtgcatctaaacgcgcagcgtgggagttctaagttatggctattattcagaatgtaccgtgtcctgcttgccaaaagaacggacatgatattactggcaatcatttaatgatctttgacgacggggcaggatactgtaaccgtggtcacttccatgataatggcagaccctactaccataagccggaaggtggcatcgagataacagagttacctattactggcaatatcaaatatacaccttctcaattcaaagaaatggagaaggaagggaagataagcgaccctaaattacgcgccatcgcacttggtggtatgcgtatgaaagaccgttgggaggtcatgaatgaacaagaaagggcagagcaagaagcagagtggaaacttgatgttgaatggttcctcacgcttaagcgtaagaaccttgtttccagacacattcgcggcgacatttgcgcattgtatgatgtacgtgttgggcacgatgaagagggtagagtctcacggcattactatccgcgcttcgaaaaaggtgagctagtaggcgctaagtgtcgcacattacctaaagattttaagtttggtcatttaggtaaactctttggtatgcaagatcttttcggtatgaatactttgtctcacgtgttagacaagggaagacgaaaggattgcttgctcattgtcggcggcgaactggatgcactagcagcgcagcagatgctccttgattctgccaagggtactaagtgggaaggccagccataccatgtatggtctgtcaacaaaggcgagtcttgccttgaagagatagtgcagaaccgtgagcatatcgcccaattcaagaagattatatggggttttgatggagatgaggtagggcagaagcagaatcagcaagcggctcgcctgtttcctggtaaatcctatatccttgaatacccctctggttgcaaagatgctaacaaggcattgatggctggcaaggctaaagaatttgtagatgcatggtttaatgccaagtcatctgatgaagtctttggtagccagattaaatctatcgcatctcaaagggataagctcaaggctgcacgtccagagcaaggactatcatggccttggcctaagctgaacaaggtaacgctaggtattcgtaagaaccagcttatcattgtaggtgcagggtctggtgtaggtaagactgagttccttcgtgaagtagttaagcacctcattgaagaacacggtgaatctgtgggcatcatttctacagaagacccgatggtcaaggtgtcccgtgcttttatcggcaagtggattgataagcgtattgagttacctccaaccaacgacccgaaagaagacggataccgtgaggtgttcgactataccgaggaagaagctaacgccgccattgattatgtagctgatacaggtaagctgtttgtagctgacctagagggtgactattcgatggaaaaggtagagcaaacttgcctagagtttgaggctatgggtatttctaatatcatcattgataacttaacggggattaaattagatgagcgtgcttttggtgggaaggttggtgcacttgatgaatgcgtcaagcggattggtactatcaaagaccgacacccggttactatattccttgtatcacaccttacacgtcctccggcaaaccgtacccaacacgaagaaggtggcgaagttatcctttctgacttccgaggctcaggcgctatcggattctgggcatcttacgccttggggattgagcgtaatacaagagctgaaacgcttgacgaaaggactaccacgtacatctcatgtgtcaaagaccgcgaccaaggtatctacactggaaccaaggtcatgcttaagggtgacattcaaaccggacgtttaatggaaccacaagcccgtactaagtcatttgatacaggtgaagcaaggcaacaagaagtaccagatttaccggacactatagaagagactaacttcgatgaagaaagtgagttctgattagtgtatttatcagggcttgtctcacatgtgagacaggctcttattaagtacattaaataactggagattgattatgtataacttagtgttgaatgtaggtgactttgtacgcaacatcaagaaagattcaagtcgctatctttgccgtggtgttgtaacctttgtaggtgagaacctgtattatgtagaatatcgcagtggtgttaagcaatattaccacaagaagacagcacataaatatcttgaaaagattgtagagataaacaatcaatgtaagtgcatacatgatgaggtttgcgataaatgtgctcgccagatgcttaagaatttcctagctcctctttattatggtgctggtcctcaaacactagcagagtacatggcagaaaagaaaaccacactcaagaaagagcgtcgcaatgtaatcactggtaagactcaaagtgagatgattaagcaatgtggcactgcattaggtgttacacagtttaatactcgtgcattgggtaaatccacaggacaagctatggtaaagattggagaagccatgatgcatccaaatgtacctgtgcgaatcatggatgttgaccatgcaatcacagaacaaggtacgcaacgacgtgtaattaataagcattttgccgacactatagaaggtattattcgtaagcaagggttgaaaggtcttcacatcttaaatggtgaagaattactgtacctacctatcgttactgaagaaacatacgtgaatatctaaggagttaatcatgactaaggtattaatttatatgcgtggacctcataaatgctatgcagttgtagcaccaaatggtgttaagccttatcgtacttcaaaaagattggcattaataggtgctagtagtagtgcaagtttccaaatggaactttttggtcattggacggaaaggcaattccgtgaggattttaaagtcattggcagcttcatggtgaaatatgcagaataaacatagtcttaaaatgttcgatggtcatgaagacctgcaagccaagattactaaccaagccttcctgttcgctcaggtaactatggctgaggccaagaagaatagtctcactcgtgaacaggttatcaaggaaagtgaagtgaaacgtaagattcgcagtcgataagtcaagggttgtctcacgtgtgagacagcctttcatcatattgattggaggtgcattatgccacgtgattatgattctgattgggactattatgactcaatgaatccaaaacccgaacgttcagatgattactacgaaacagaggcaatgtatgaagactattgattggaagaaggaggcagaaggtcgtatcctcgtgatggatgcggaagctaaaggactccttgacgccatccgatatggacaccgtgaagatgtgcatatcatttgctgcatggacttgcttactaccgaggagtttctcttctttgacccgtatgagatgcgtgaccctgaagcaagagaacgcctgaaggaatgggaaggtcatcaagatggaaccttggttgacggtgttagcttcctgaagcactgtgaggctattgtgtcgcagaacttcctagggtatgacggtcttctctttgagaaagcattccctgatatttggaaaggctttaactataccgagaagcgcggcaagggcagactccgtgctgacctgtgtccggtgcgagtcatggatacgctggtgatgagtcgcctgttaaaccccgatagacgccttcctccgcaagcatatgccaaaggtatgggtaacgtcgcccctcactcaattgaggcgcacggcatccgtataggccgctataaaccggagaacgaggactggtctaaactaactgaccacatggttcaccgtgtacgtgaggacgtggcgattggtcgtgacttgttcctctggctctttaacggggaatggatggagcacaaacgccgtggcgtgaataaacgcactggcctaggtattgagacagccttccacatggagtccattgtggcgctggagatgagccgtcaggccgagcgtggattccgtctggatatagataaagcattagcacgatgcgaggaattggacgctaagattgatgagacagtcgcagcgttccgtccgcacatgcctatgcgtatcaagtctaaaccttttaaaccggaagaaaagaatgaagtatgccaacgcgcaaatgagtatggagctagcaacaatatacctactgtccttgacccctcacactttcttcatgccgagagacgaggagatcgcaagacagtatggagtgtcactactaagtctggtgattggtcggctagtgtcaagaaagactttcctcaccttagaggaaaccgtaatgacacgccaagcatcaagtggattggcgcttactcgcctgttactttcgaagagattcccttgggtaacagggatacagttaagcaagtgctctatgattatggatggaaaggtgttgaatttaacgataccgagcaagcgcatctcgatgagcacggagtgttacccaaaccttggagtggtaagataaatgaaaagtcccttactttatggcaagaaagagccgcacgtgaaggtaaaacagtccctgattggtgcttgggtatcgctgcatggtacatactcgtatcccgtcgtggtcagatcctcaaccgtggtgacgttgaagccttcgaccagaagggggtgtggccttcgcaagctggtacacgaaagtgtcgcggccttgtacctgtagcatttaacaaggagttaggaatcaatgctcagcaatactacgaaaggtacggatgctggcctacgtcagacaaggatgacggagaatggcgtgtgccagctattgctattagtattggaacttctacgttccgtatgcgtcatcgtaacgtggttaatattcctgcccgtggtttgtatcctttacgtgatttattcatagccggtaaaggtaagctaatccttggttgtgatggtgctggtcttgaactacgtgtactgtctcacttcatgaatgaccctgaataccaagatattgtactgcatggtgacattcacacccataatcaaatgaaggctggtcttcctaagcgtgacatggcgaagacatttatatatgccttcctatatgggtctggtatagctaaccttgcagcagtatgtggtgttactgaggaagaaatggaggaagttgtggcaagatttgaggttgaactaccatctcttgcacgtcttcgtgagaatgttatcgcacaaggtaacaagtttggctacctacaagcacctgatggtcattggggtcgcatccgcatgtctggtggtgaacttaaagaacacactatgcttaacgtactactccagatgactggttctctgtgtatgaaatacgcattggtcagagcgtttgcagtgatgcgcaaggaaggtgtggccttagatagcatgggaaacccttgcggtatagctaacgtgcacgatgaaatccagatggaagtccctgaagatgaggtcttgtatctcaactacgacttgcctttcaccttagaagggttcgaaacagagaaggctgctgtgaaagcagtgttcgatgcagaggagaaacgtgttcatgtggattctgaaggacgtatgtggtctgctgcaaatctcgttagtattgatgctgatgctggtgtacttcattgccagcgtcgttatcaccgtgcagggcatatcattgccgacgcaatgacctgggcgggtcagtacctgaagatgcgttgtccgatggcaggtgagtataagattggtgcaagttggaaggaaacacactgatggacaggtttgatattgtttgcctattctctaccttctttcttatattccttatgcttgcttgctatggaagtatgcgattagatatacctgatgaagaggagggttacgattgatgcaggcatcttttattattcttggagtcatattatttatggtagtattctgggctttctctggcattgacccagattgtgatggtaactacgactgagttatactcaaggtcacttacgagtggcctttatgaataacttattcctacttattttgtctaacatgatttactggacactatagaaggaaagcataggtaatctaggttataaggtagtataggtaattaagtaaatataggagatataaatatgtctatggtaactactctggtattcgtggctcaatactttcgtggtcttgctaataagttcaagtccaaggctatcaaagctattgaggctcgcatcgaagcagtacaggcagagcaagttaaagttgaagaacatcgtagttctcaaatgattgactgtcataaccgctactatgcatctcgtgatgaactaaatgcacgtcaagtcaaagaggtagaagatatgctggcacgtcaccagcaagagcgtgacagcctgaaagctgaatttgaagagaacaaggcatcaattgcccttgtacatcaagctgcatctgacagtctgaagaaagagattgttatgctggaaatcgaactggataacctgaccaaataaggggttatgatggaagaagtaattcaagctaaacatgtaggtattatctttcgcgatctagagcagcgtaaagttgcaggtcatactcgtctggctaaagaggaagacaccgcaatcactactgtagaacaagcagatgcctatcgtggaccagagttcactcaaggtgaaacttgtcaccaattgagcctgtcaatttgtgacactatggctattgtaaatgtgcaagaagtcgaagagggtgagtgtgtcagttacatctaccctttagatactattgcacgcattaaggtaatccataagtaattactagacactatagaacaataggtcggcttagttcggcctatgattgtgtagtgtaacaataggagactaaataaatggcacgtggtgattttgattttggtgctcagattactaaatctgaaggtaaagtctttaagaatccagaagtaggtgatcatgaagcagtaatctctggcatcattcatgttggttccttccaagacatctttaagaaaggcaataccactgaagttaagaagccagcaaactttgttctggttaagattgtcctgatgggcgacgatgataagaacgaagatgattctcgcatggaacaatggatggctgtgcctctgaagtctggtgataaggcaacactgactaagttcctgaatgcagttgaccctaaagagttgctgggtggcttcgatgatttcattggtgaatgcctgactgcaacgatggttggttctggtgacaagaatgaagatggctcattcaagtatgttaactggaagggatttggtggtatgccggacaagctgaagaaactggtcattgctcaggttgaagaggaaggtctgtctatgacaggtcacattaccttcgacaagctgaccaaagaaatccttgatgacatcccagccaacttggtgcgtcaatacttcctgaacgagacgcctcgtggtaagaacctgtctgttgctggctctcatgtagaagcaataattaaagctgctcgtgaagaagacccagagtggaagaaggctaagaagaaagatgacgaggatgctactccagctaatcgtaaatctctggatactggagagtctgttccacaggaagtacctgaagcagaagatactcctgcaccggagatggatgaggacgcggaatattaaggagaaaggatgaaagtacaaatcgtaaccctgcactgcaagaaaggtatcacaacgctaggaggtggcactttccactctttctccgaaggggagatttatgctgacctgcactacatctggcgcgacggacagcacgtggtgaactacagcgacccagctacggggaaacgccacggcgtatcgcttccggcgcatgacattgctcaggtgaacacagttttataaagtctcacgtgtgagacaaatcggtgtccggtatttactggacactatagaagagaagaattttaatcggcgataatgccataaccaacaaaaggagaatttaatatgttcaagattgaaactatcgtaaaccgtgttgttaaaggtgctgctctggtatccgttgagtctttcattatcgtcgatgaaactgatcaactggtagctggtactaaggcttacgatacccgtgaagaagctcaggctaagattgacagcatgggtaacttcgctgctggtctggagttcgctcgtgcctgcttccctgagcaggctgacaaagcccagatcgggaaggctaacatcgtagctgaatatctggattgggttgctgctggtaaaccagtgaaagaagttaaggctgctgaagaagctgaagctacggcagtagaagtagctgcaccggaagctccggtaagcgaagaggaagaattttgataatagcaggtgttgcctctgttagtcctagctgactatcacgctcacctcatccaatgccctgtctgccttagtgtaggcagggtcttttgcgtaatagttattggagaatgaattatgccgactattgaatctcgaattgaactggacattagctacaatgcaatcaccagacagtatattggggttgcctatgattacaaaactggtgagaagctagtggaggtgagacaatgggatgactattggttaagacagaacctccatgatgcggtgtcctccttcctgaaggagtggcctacatgcgaccaaacttcgacttcggagctacagtatcggaagacaataacctgttgctgtggccaactgaaggtaatcgaatcgctttaatagatgctgatatgttaccttacatcgtagggtatacaatcagtaatatgacttatgtacgagccacaactcgtgttaagtcagggcaagtcccctcaatcaaagatacacctgagtgtaagcaagcgtgtgaccgtgtgaactccttgcttaactcttgggtgtatgcagcagaatgtgatgcagctaagttattcatgacgaaatcagaagctaacttccgtgtccgcctagcattcaccaaaccttataagggtcaacgtaagaccgagaagcctccgttcttctatgaattgcgagagcatctcttagaggttcatggtgcaatcttggcagatggggaagaggctgatgacctcatgagcatcgcacaatgggacagccaccgccgcttccagcaagatacaggtaacgagttccctatcggtagtccagagcataaagcattctctgatacttgcatcgtttccttggataaggatttgatgattgttcccggttggcatcttcagcctggacaagagaagaaatgggtagagcctatgggttggcttgagttacgccgtaaggctaatggtcaggttaaagaccttaaaggtgctggcctcatgtttcattatgcacagatgattatcggtgatgatattgataactatgctggcatacctggacgtggtgctaaatacgcctatgaccttctcaaagattgtaagacagagaaagagttgtacatggcagtgcttggtgcttacaaggctaagttcggacatggacaagttaagattaagaattaccgaggtggttatcgtatcggcaaggcttttgacctgatgctcgaatgtggtcgcctagctcacatggcaagattcaaaggtgatatatggcgagccgataagaacccaatcttgtggggagatgatgcggaatggttagcaaattaaaatcatcggaggtagcagcttataagagggaattgctagagaagcaaggatggaagtgccccctatgtggcggcagtctcaaggctgttacccctataaaccgtgtacttgaccatgaccatgagacaggattctgccgtgctgttgtatgccgaggctgcaatggtgcagaaggaaagattaagggtgttatctctggttatggtaaggctggtaacaaccgttacttccagcttcaatggttagagcgactatatgaatactggaagttacatagtacgcctcagacagataagttatatcacaaacaccaaacggaggcagagaagcgcgaggctaagaaccgtaaggcacgccttgcttatgcaagaaagaaggaggttaaagttgggtaagcttcgcagcttgtacaaagactccgaggtacttgatgcaatcgagcaagctaccgacgagaaaggtaatgttaattacaatgagatggcacgtgtattatcgtgtcaccctgtgggtaagaagattacccgccagttggctcgatactggcatggtcaattcaagaagaccaagaagaatggtgattattaccagacccttctgcaagaagataagcgtatcaaagaagagcgtaagctcaggactcctgaccgctacgaggatttggctattgtgccattgcctgactcgcctcatcgaagtgtactggtgatccctgacactcatgcaccttatgagcacccagataccctagagttccttgcagccgtggcagcacgttaccgtccagacacagtggtacacctaggagatgaggcagacaaacatgccctgtcgttccacgattcggacccaaatctggatagtgctggcatggagttagagaaggctcgtatcttcatgcacaaattgcacaagatgttccctgtgatgagactgtgtcactccaaccacggctctatgcacttccgtaaggcaagcgccaagggcatccctgtgcaatacctgcgcacctatcgtgaagtcttcttcccgcagggaggtggcgaccagtgggattggcaacatacgcacgtccttgagttgccgaatggtgaacaagtggcattcaagcatcaacctgctggctctgtcctagcagatgcagcgcatgagcgtatgaaccttgtgtgtggtcacttgcacggtaagatgtctgtggagtacgcacgtaatacacatgaacagtattgggctgtgcaaggtggctgcttaattgatgagtcatcccgtgcatttgcctatggtcgtgagtctaaatacaagccagcattaggttgtgtggtcattctggagggtgtgcctcacattgtcccgatgcaaaccaatagcgacaaccgttggattggcaagatttagttgacactatagaacaaagggctaggtaagactttatcggctggcgtatccaaatgatattgcactagcccttgattgtatagtgaatggaggattcaatatgtcacactatgaatgtaagaagtgtcataagcgttatgattactgtacttgtggtcaagagaaaacatcttttaaagttggagacaaggtatttcgtaatgaaaaagattcgattccttggaatcaatactgcaaagaagctggtattgaccctgatagccctgtaaccatagatgatattgatggcattaacttgtgctttcgtgaggtgaggggtacaggttgggattccaaaaaattcaaacttgcatctgataagttagacaacaatatggtaactaatcctaagcactacgagttctttgatggcgtagaggcaatcactatcattgcccgcagtatgaccgagaagcaattcgctggctattgcatgggtaatgctttgaagtaccgtctacgtgcaggtaagaagttcaacactgaagaagacctgaagaaagcagattactacaaagagttattccagaagcatcgtcacgaatgtattgatgaggatatttgatatgaatatctttgagttcctaggtcttccagaagaccaccgcaatcacccattcatgctggtgaagcatcgcggtgaagttcctgagaagaaattaacttttccatgttatgcacaggtgaaacgagatggtatcttttctgctgttgttgttcgcactgatggtgtcgttggcatttttggtcgcactggtaagaaattggcaaacactgaaggactcgaacaagcctttgctacctttccggttggcatttatcttggtgagcttcagtctatggccattgatatctaccttgaggcaatctctggggttgtgaaccccaatcgcactgagccacttgatttcataggccagcagattaaagacaaactgtatatcgacttcttcgatatgttaactattaaggcattccatgatggattcactgatgtttcttatctcaaacgttacgatgctttacatcgtcgtatcggcgctcatcttagcgggtacaacgctatccttcctattactccttgccataatgagcaagatgttgaagcgtttgcgcaagagcaaatagatgcaggccgagagggtgctgtattcaaactggactgcgattatgaagcaggccacaaaggttatcgtcagactaaagaagtccgtaaggtaacttatgaccttacttgtattggctttgaagaaggtaaaggtaagtacaaaggtaaggtagctaacctcattttcaagtggaaaggaggcaagacaatcaaagcgatgttaggtaaagggtggactcatgcagatgcagaacagatgttccacgacattaaacatggtggacgattgaatgtcattggtaaaatctttgaagtcaaaggtcttcaggattcaagcaagggcaacattcgtctgcccaaagcgggagaattaagacatgacaaagatgaaccagatttcttttgatagcatgaaggcaactcgtgcagttgaggtagcagaagctatctttgaaactttatcctgtggcatggaagtgccatatactttacttgctgatgcagaagaacttggtctttctgtagaagctatccaagagaaggttgacgaattatatggtacagacgaagaagaaaccgacgatttcatttgaaggaatggagatgcttgagatgattctcaagccttcttctccgaaggtgactaagactcatgaagagttaatcgttgatgaagtgaagcgttacatcatggattgtgtcagagcacaactggtggtccaatgatacgtccagcttccttcctagatattcctgagattataaaccttgggaataaatatgtggaagaggaagtcaaggtagtggcccatcactcagcctcatgggatgcagaacaaagcgcacattacctttgcgcatctcttagtagagaagatttattcctatgggttgctgtagatgaagggcggattgtagggttcctgtgggctggctatcacgagttggccccttggacacctgtaagggttgcctctgacattctcttttatattataccagagaagcgaggaaccctacttggtatgcgtctcatcaaagccctaaagcaatgggctagtgataatgaatgctctgaggttcgcctgtctatcgcctctggtattaatgaagaacgtgtcggacgtatgtataagcgacttggctttgaaccgtttggcactgtgtacaacctgaagttctaaggagataacatgggtgttgtaaagaaagcatttaaggctatcggtcttgctcaagatgcaccacgtattgaagccaaagtcccagcacagcagcttgagcgtaagcctgagactgaagctgaagatattcaaattggtgcaggcggtgatgatgcgactgcatctgcaaaaggtaagcgcggccttgtccgtccggtagcttctagcttgaaggtgtaatatgaaacagagcacagatttggagtatggaggtaagcggtctaagatacctaagctatgggagaagttctccactaaacgtagctctttccttgatagggcgaagcattactccaaactaaccttgccctatctgatgaatgacaaaggtgataacgagacttcgcagaatggatggcaaggtgtaggtgctcaggcaactaatcatctagccaacaagctagcgcaagtactattccctgcacagcgttccttcttccgtgtagacttaactgcacaaggtgagaaggttcttaatcagcgtggcctgaagaagacagagctagctaccatcttcgctcaagtggaaacacgggcaatgaaagagttagagcaacgtcaattccggcctgctgtagtggaagcattcaagcatcttattgttgctggtagctgtatgctatacaagccgagcaaaggtgcaatcagtgctatcccaatgcatcactacgtagttaaccgtgataccaatggcgacctgttagacattatcttgctacaagagaaagccttacgtacctttgacccagctacacgtgctgtagtagaggttggcctgaaaggtaagaagtgcaaggaagatgacagcgttaagctgtacacacatgctaagtatcttggtgatggattttgggaactcaagcaatctgctgatgatattcctgtaggtaaggttagtaagatcaaatcagaaaagctacctttcatcccattaacttggaagagaagctatggtgaggattggggtcgccctcttgcagaggattactccggtgacttattcgttatccaattcttatctgaagcagttgcccgtggtgctgcactgatggcagatattaagtacctgattcgtccgggtgctcaaactgatgttgaccactttgttaactctggcactggtgaggttgtcactggtgtagaagaagacatccatattgtacagttaggtaagtacgcagacctcacacctattagcgcggttctagaggtatacactcgccgtatcggtgttgtcttcatgatggagacaatgacacgccgtgacgccgaacgtgttactgctgtagaaatccagcgagatgcgttagagattgagcagaacatgggtggtgtatactccctctttgctactactatgcaatcgccagtagcgatgtggggtctgctggaggcaggggagtccttcactagtgacttagtggaccctgtgattatcacaggtattgaagctttaggacgcatggctgagttggataaactggctaactttgctcagtatatgtcactgccattacaatggcctgagcctgtcctagctgctgtgaaatggcctgactatatggattgggtgcgtggtcaaatctctgctgaactgccgttccttaaatcggctgaagagatggcacaagaacaggaagcacagatgcaagcacagcaagcacagatgcttgaagaaggtgtggctaaggccgtgcctggtgtaattcaacaagaacttaaggaggcgtaatgtctttctcatttactgaaccgtcaaccactcaccctactgctgaagagggtccggtagaaaccaaggaggtaacaactgatgctgctactactgatgctcctgctgacgctggcacttctgtacaagatgacaatgctggtgcacaacctactgaagacaccggaggagaagcttctggacagccttcagaaaaaggagacaatggcggagagaatggtgaacctaagccagatgataccgcgaccgacactgaggaagtgcaatacttcttcggagaacacgaagtaacagtagacatcccacaggatgtaactgacagccttaaagagaaaggcattgatgccaagcaggttgccaaggaactctattccaaaggtggcaagtttgaactgtcagatgcaaccaagcagaaattgtatgatgcttttggcaagtttgcggtagatgcttacctatcaggtctaaaggctcaaaatgaagccttcttcctgaaagaagccaacgcagctaaagagttggaagcagctaacacccaacgcttctctgatgtttctaaggaaattggtggcgaagaaggttggtcccgtcttgaggagtgggcgcttgaaactctatccgatgacgaactcacggcattcaatgcggtgatggagtctggcaaccagtacctccagcagtacgctgtgcgtgaactggagagccgccgtaagcaggcacagggggatgataagccatccctgattgagccatcagcacctgctaaggctaatgaagagaatggcccactgacgcgagatcagtacgttcaagcaatcgcaactcttagccagaagtacggcaatgaccgtaaagctatggcagaagctcaggctaaactggacgcccgtcgccgtgctggcatggctcgcggtatctaattcagtatttactggacactatagaagggagaaaagttctccctagttatcaatttgatttataaggagattataatacatgtctacaccgaatactctgactaacgttgctgtatctgcgtccggtgaggttgacagccttctcattgagaagtttaatggtaaggtcaatgagcagtacctgaaaggtgagaacattctgtcctactttgatgtacaaactgttactggcactaacacagtgagcaacaaatatttgggcgaaactgagttgcaggtgctagcaccgggtcagtctcctaatgccacccctactcaggcggataaaaaccagttggtaattgataccactgtcattgctcgtaacactgtggctcacatccacgatgtacaaggtgacatcgatagtctgaaaccaaaactggctatgaaccaagccaagcaactgaaacgtctggaagaccagatggcaattcagcagatgctgttaggcggtattgctaacaccaaggccaaacgtaacaagccgcgtgttaaagggcatggcttctctatcaacgttaacgtaactgagagtgaagcactggctaaccctcagtatgttatggctgcggtagagtatgctctggagcaacagcttgagcaggaagtggacatctctgatgtagctatcatgatgacgtggaagttcttcaatgctctgcgtgatgcagaccgaattgtagataagacttacactatcagccagtctggtgcaaccattaatggcttcgttctctcttcttataactgccctgtgattccgtctaaccgattccctaccttcgctcagaatcaggctcaccacctgttgtctaatgaagataacggctatcgttatgaccctatcgcagagatgaatggtgcagttgctgttctgttcactgccgacgcactgctggtgggtcgtaccattgaagtgactggtgacatcttctatgagaagaaagagaagacttattacattgacaccttcatggctgagggtgcaatccctgaccgttgggaagcagtgtctgtagttaccactaaacgtaatgcaacttctggtggtgctgctgaaggttctggtgatgatcacgcaaccgtactggctcgtgcacagcgtaaggctgtatatgtcaaaaccgaaggtgctgcggctgcattctctgctgccccagcaggtatccaagcggaagaccttgtagcggcggtacgtgctgtaatggcaaatgacattaagccgactgcaatgaaacctactgagtaacacctatgccctatctaccttgcgtaggtagggttcttttttgttaggaggattcatgcctgtaattagacaaaccagtaaattaggacatatgatggaagatgtggccttccagattattgatagtaagctggaagcggtaaacttgtgtatgcgagctattggtcgtgagggtgtggattccctcgactcaggggacttggacgcagaagatgcaagcaaaatgatcgacatcgtatcccagcggttccagtacaacaaaggaggtggctggtggttcaatcgtgaaccaaactggcaacttgcaccagacactaacggtgaagttaatttacctaacaactgcctagcagtattgcagtgttatgctttaggtgaaaagaaagtacctatgactatgcgagcaggtaagctctactctacttggagtcacacctttgatatgcgtaagcatgttaatgctaatggtatgattcgtcttaccttactcaccttactaccctacgagcatctacctacaagtgtaatgcaggctattgcctatcaagctgctgtagagtttattgtgtctaaggatgcagatcagactaagctagccactgcgcagcagatagccactcagcttcttatggatgtacaatctgagcaaatgtcacagaagcgattaaacatgctggtacataaccctactcagcgtcagtttggtatcatggctggtggctctcagaatgtacctgcttactctcattcaccttatgagaattgggcgctccgtccgtgggaggatcgttaatggaagtacaaggttcattaggtagacaaatccaagggattagccagcagccgccagcggtacgcttggatggtcagtgcacagctatggttaatatgatacctgatgtagtgaatggtactcaatcacgcatgggtacaactcatattgcaaagatacttgatgcggggactgatgacatggctactcatcattatcgcagaggtgatggtgatgaagagtatttcttcacgttgaagaaaggacaagttcctgagatatttgataagtatgggcgcaaatgtaatgtgacttcacaagatgcacctatgacctacctctctgaggttgttaatccaagggaagatgtgcaattcatgacgatagctgatgttactttcatgcttaatcgtaggaaagtagttaaagctagtagcaggaagtcacctaaagttggaaacaaagccattgtgttttgtgcgtatggtcaatatggtacatcttattccattgtaattaatggggccaacgctgctagttttaaaacaccggatggtggaagtgcagaccatgttgaacaaattcgaactgaacgtatcacttctgaattgtactctaagttgcagcaatggagcggtgtgagtgactatgaaatacaaagagacggtactagtatatttatcgagagacgggatggtgctagctttacaataacaaccaccgatggtgcaaaaggtaaggacttagtggctatcaagaataaagttagctctactgacctactcccttctcgtgcgcctgctggttataaagtacaagtgtggcctactggcagcaaacctgagtctcgttactggctgcaagctgagcctaaagagggaaaccttgtgtcttggaaagaaacaatagctgctgatgtattacttgggtttgataaaggcacaatgccttacattattgaacgtacagatatcatcaacggcatagctcaattcaagataagacaaggtgattgggaagatcgtaaagtaggggatgacttgactaaccctatgccctcttttattgatgaggaagtaccccagacaataggtggaatgttcatggtgcagaaccgcctatgctttacagcaggtgaagcggttattgcttctcgtacatcatacttcttcgatttctttcgttatacggttatctctgtattggcaactgacccctttgatattttctcagatgctagtgaagtctaccagctaaaacatgcagtgaccttagatggcgctaccgtgttgttctctgataaatcacaattcatactgccaggcgataagcctttagagaagtcaaatgcactgcttaagcctgttacaacatttgaagtgaacaataaagtgaagccagtagtaactggtgaatcggtaatgtttgccactaatgatggttcttactctggtgtacgagagttctatacagactcttatagtgacactaagaaggcacaagcaatcacaagtcatgtgaataaactcatcgaaggtaacattaccaacatggcagcaagcaccaatgtcaacaggttacttgtcactaccgataagtatcgtaacataatctactgctacgattggttatggcaaggaacagaccgtgtacaatcagcatggcatgtatggaagtggcctataggtacaaaggtgcgaggtatgttttattctggtgaattactttacctgctccttgagcgaggagatggcgtgtatctggagaagatggacatgggtgatgcactaacctacggtttgaatgaccgcatcagaatggataggcaagcagagttagtcttcaagcatttcaaagcagaagatgaatgggtatctgagccgctcccttgggttcctactaacccagaacttttagattgcatcttaatcgagggttgggattcgtatattggcggctttttcttattcaagtacaaccctagtgacaatactttgtctacaacctttgatatgtatgatgacagccatgtaaaagcgaaggttattgttggtcagatttaccctcaagagtttgaacctacgcctgtggttatcagagacaatcaagaccgtgtatcctacattgatgtaccagttgtaggattggttcaccttaatcttgacatgtaccccgatttctccgtagaagttaagaatgtgaagagtggtaaagtacgtagagtattagcgtcaaaccgtataggtggtgctctcaataatacagtaggctatgttgaaccgagagaaggtgtcttcagatttccactgagagctaagagcacggatgttgtttatcgtattattgtagagtcacctcacacattccagcttcgcgatattgagtgggaagggagctacaatccaaccaaaaggagggtctaatggctataggttcagccgttatggctggtatgtcttctattggtagcatgtttgcaggcagtggtgcagcagccgctgctggaggtgctgccgcaggtggcggaggtttgctaggttcactaggtggattcctaagtggctctactgctggtttctctaatgctggccttcttggtgctggccttcaagggttaggcttgattggtgatctatttggtggaagtgatgaagccaaggcgatgaagaaagcacaagaagagcaatggcggcagcagcttattgctacacaagaggcgtacaagacagtggcagacgcagaacgttctgctgctaaacaatatcatgcagatgcaatcagtaatcaggtttcactgctacagcagcgagcacaggttgcattacttgctggggctactggtactggtggtaattctgtgtcctctatgcttaatgacttagcagcagatggcggcaggaaccagagtactatcattgataactatgagaatcagaagattaatttcaccaaccagcttaagtctatccaacgtggtggtcagatgcagatgcgtgagtttaagaagccttctgctatgaataccttggttaaaggtattccaagtctggcatctgcctatgtaactggtagtaagtctggcaaggcattgggtaaagccttaactgattctcgcacatattcatctggaacaagaggtatttaatggcaattgagcgacaagcagtacaaggtctgccacaagtgcaggccacttctcctaatgtcatgacctttgcacctcaacaagtgggaggtgtggaggctggcgtggcttctacctccggtagtaggtttatcgaagaccttattcgtgcagcaagcagcgtggctgatgttaccactggtatccttaatcagaagattgaggaagataaggttgttcaaatggaacgggcatataacggattaatgccttctgaggatgcaactcgtggtggcgctcgtgctaacatgcttgtcaaagctcaactgctagctaatgatgaagcagcacgaatgaaagacatggctactcgtttccaaggaacggatgacgaatggacacaacttatggttgactctcgtaatgagatgcagaataagctgttccagcaataccccgagttgcaaggtgacaaagatactatgcgtatggtcactaatgtcttccaagaacagcagcctcagatttgggctacacgaacccagcataaacttgaccgtgaacaagcagaccgtgaggatacctttgacgggcgagtggcttctacttgggattctaatattgaccctgaagcctctggctatgctttacaggaacgaatccgcgaaggtcttactcaaggattactacctgaacagatgtacaagaagttagtccagcgagcaatttcacttgcacaaggcggtgatgttagcatggctgaagccctgaagtatgtgaaggacgataagggtgtttctgtttatgctaagaatccacagcttatcacagccatcactagtggtaatgcagtttgggctaggaataatgtagctgatgtaactcgtatgtctttcgaagttaaagaatcctaccttgcaggtgatttaactgatgaagaattgttggaacgagcacagcacattaataatctgacaggtaactctgtcttctctaatccagaactagaggcactgatgcgccaacgggctaagcagaatgcagagctaggtgcaatgcaggatatgcgacgtgagctttactccgaccgcctgactggcttccaaggtaagactgataaagagaagaaggcttacattgatgttatcaaacaggatagccaactttatgcagaccagcaaatcaaacaacgtggcttggacccttacagtcaagaggctgaagctattcgtggtgcagtggaagtgcagcgcctgcaattcatgaactccaaaggcttagtggatgatacctttgagtctcgtatcaaagccatggaatctatgctatcgcctgagcactttgccaagggcgaaccacaggagttgatgactattcgccagttgtgggaacagttaccagaagagagccgaggtgtctttggtgacacggtgaatggctacatggataactacaacactgcactacaaatgggagagacacctttgcaggctgcaaggtttgcgcgtaaagcacagcagaaattctctcgtactgagaaggaaaccaagaagttcaactcagctattggagatgcactggatgaggtatctggtgctggctggtttgatggtaaaaccgaagtgtcagacttaggtaaagctattgcggaagaagagttacgagctaaggccaatatgttgtggtctagtggtatgcgtaacatggattccatcaagaaggctttaattacttggggcaataaacgctacactcaatcagaggatgcaaagacttccggtggctatttcattaaaggtgattacacttctgcatctgatatgcttatgtcagttgggaaaggcgtaaaccctaccgatgtacctctggcgcttggtaggtatgtagaaacacagatgccagaattgaagaaggagcttcaagagggggaaactaaagatgatatatacattgattacaatgaacagaaaggtactttcgtgattcgtgctggtgcagcaggtcgccctctttctggagtaatccctgtaacctctttagataccacttcactgctagattctgcctatcagaagaaagtagaggaacgagatagaggcgagtatgttcacccgtatcgtacagatattggtgcacaagagcctatgccagctaaaccaactgccaaagatattggtaaatttggactagctaacttcctcatgtcttctgcttttgcttctggtgagaatctgccttctaacttcgagattaactatcgaggtaatatgcaacaattctatgacaagctagctatggatgagaataaagataaagttggctttaataaggcaactggaacctttactccatataaagacgctcgcggtgagtctatcggttacggtcatttcttaacggaagaagagaagcgaaacgggtatattaagattggtgatgaactagttccctatcgagggtctatgtctcagcttacagagagcaaggctcgcgctcttatggagcaagatgctaagaagcatgtgcctcctactcgtgactggaagattccgtttgaccagatgcatcctgcacagcaacgtggcttgatggatttaacctacaatttaggtaaaggtggaatccagaactcaccgcgtgctcttgctgcattcaaagctggtaagcttacggaaggctttatcgaaatgctgggcactgcatcaagtgaaggtaagcgtattcctggcctactgaagcgacgcgctgaggcatacaatatggcatctgctggtggtgtgcctaagattaccgaagtggagactcgtgaagatggctccatgtgggttaggtttggtggacctatgccagcaggttctgtctcggcatggactcataaacgtattggcgcggatggttggtatcaggtttatgaggctgcacctaccaagttagctaaaggttctaaggtaggtaaagttaagttgtagtacctaactcaaggcttgtctcacatgtgagacaggtctttatgataggcactatggaggaattatggaacaagacattaagactaattgggctggatatgtccagtctactcctgagccgttttctattgaggcggctccggtatcggctcctacgatacgccagcgtaatgagttacaagagcaagttcttgaagctaaagctgacgctgatattttaggtgctgtaggtgctgccttccagaatgagtggttggcattcggaggcaagcggtggtatgaccgtgccactgctgatttcacacctcaaccagactttgagatacaacctgagcaacgtgaagcactacgtttcaaatatggtacggatatgatgcagacaatcactgagggtgttcgttctgaggatgaattgaacttccgtattcagaatgctgatgaagaccttgagcgcaataagcgcattgctcaggctggctgggttggctctgtggcgacgattggcgctgctgtgcttgaccctgtgggatgggttgtctctattccaaccggtggtgccgctaaagttggactcgtaggccgtgctgtgtgtggcgctatcgccgctggcgtgagtaatgccgctattgaatccgtattggtccaaggtgacatgactcgtgatttagatgacattatggtagcactaggttccggtatggctatgggtggcattattggcgctgtagcgcgtggtagggccactaagctcagtgagcaaggggatgacagggctgcgagcattgtgcgcagtgcagacgcaggggaccgctatgtgcgtgctgttgctgatgatagtatcggtgcgatgcgtgttaagggtgaagaggtactcactgagggtgcatttgatatctctagcaaaggtgaagatttgctgaaaaccctacagcgggaaggtaatgcaattgatatgacccctcgccgctgggccggaactctgtctgcccttggtactgtcgtacattcctctcaggatgcaagtgtacgcggccttggtgctcgcctgtttgagtccccccaaggcttaggtatgcagaaggcatctgctagtctcatgcagaatactaacttgaaccgtctgaaatctgctgatatgaatcgtttcaacgatgggttcgatttatggctcaaagagaataatatcaacccggttgcaggtcatactaactctcactatgtgcagcaatataatgagaaggtatgggaagctgtacgcatcggtatggatgagtctacgcctaagtctatccgtatggcagcagaggggcagcaagctatgtatcgtgaagcattagcattacgtcaacgctctggtgaagcgggatttgaaaaggtaaaagccgacaacaaatatatgcctgatatctttgatagtatgaaagccagacgtcaattcgatatgcacgataaagaagacatcatcgaacttttctctcgtgcctaccagaatggcgctcgtaagatcccaaaggaagcagcagatgagattgcacgagcacaggtaaatcgcgttgctgatgctaccttaactggaaagcttagttttgaaaaggcaatgtcaggtcagactaaggcagagtatgaagctatcatgcgtaaggcaggcttcagtgatgaagaaattgaaaagatgatagaagctctggataacaaagaaaccagagataacatctctaaccgagctaaaatgagtttaggattagatgttactcaagaatacaatggcattcgtatgcgtgacttcatgaataccaacgtggaagagctaacagataactatatgaaggaagcagcaggtggcgctgcattggctcgccaaggcttctctacctatcaggctgcacttaatgcaattgaccttgtagagcgaaatgcacgaaacgcggctaaggatagcaaggctagtttggcattagatgaagagattcgtcagatgcgagaaggtcttcgcctgattatgggcaagtcgattgatgcagacccacaggctatatctactaagatgatgcgtcgtggtcgtgatatcacaggtgtgcttcgcttaggtcaaatgggcttcgcacagctaggtgaacttgccaactttatgggtgaatttggtattgctgcaactactatggctttaggtaagcaattccgcttcacctctaaggcgttgcgtaatggcgatggcttcttccgagataagaacttagctgaggttgagagaatggtggggtacattggtgaggataactggctaacaactaagggtgcacgtcctgatgaatttggtgatgtaaccacagtaagagggatgatggctcactttgaccaatccatgaactcaatacgtcgtgctcaaaccaacctatcactcttccgcatggcacagggttctctggagcgaatgactaataggcaaatagctttgtctttcattgaccaccttgaaggcaagaagattattcctcagaagaaactggaggaacttggtcttactcaggagttcatgactaacctacagaagcactatgatgctaactctaaaggttctggcttgcttggctttgatacaatgccttatgccatgggtgaaactttagctaatgctattcgtcgtaagtcaggtctaattatccaacgtaacttcattggtgatgaaggtatctggatgaacaaagcactaggtaagacatttgcacagcttaagtcattctctcttgtatctggtgagaagcaatttggtcgagggattcgccacgataaaattggtcttgctaagaagacagcttacgggtttgctttgggttcaatagtgtatgcggcaaaagcctatgtgaactctattgggcgagaagaccaagatgaatatttggaagagaagttatcgcctaaagggttggcctttggtgcaatgggtatgatgagtacaactgctgtatttagtctaggtggagatttcttaggtggcctaggtgttctaccttccgaactcattcaatcacgctatgaagcaggtttccaaagtaagggtctgattgaccaaatacctctggttggcgttggtgcagatgcagtaaatctggctaactcaatcaagaagtatgcagaaggtgacacagaaggtgtagatatcgctaagcgagcactccgtcttgtgccacttaccaatataataggtgtccaaaacgcattgcgttatggcttagatgaactggaggattgatgagttatactttcacagaacatacagccaatggcacgcaagtcacctatccctttagctttgctggtagggataaaggttatcttcgtgcctcagatgtgatagtggagtctcttcaaggtaacacttggattgaagttacatctggatggcaactaactggcacgcaccagattacttttgatgtagcaccagttgcaggtttgaagttccgtattcgaagggaagtacaaaaggaatatccatacgctgagtttgaccgtggtgttaccttggatatgaagtctttaaatggttctttcattcatatactggagattacacaggagttacttgacgggttttatccagaaggatacttcattaaacagaatgtaagctggggcggcaataagattactgatttggctgatggcacaaatccgggagatgcagtaaataaagggcagcttgatgccattgacaagaagcatacagattggaacgccaaacaggacattgagattgctggccttaaggctggtatgacttctggtattgcgcacagaactgttccttggtacacgatagcccaaggtggtgagatttccgtaaacccaccttatgaatttcaagatgcactagttttccttaatggggtattgcagcaccaaattgtaggcgcatactctataagcaacaacactatcactttcgcagagccgcttgtggcgggtacagaggtgtatgtgctgattggtagtcgtgtggctacatctgaacctaatattcagttggagttgaactttgacttagtagaaggccaacaagtagtacagattggctctgcatttaagtacattgaggtctaccttgatggattattacaacctaaacttgcttatcaggtagacggtgacattgttactttctcagaaagagtaccagaatgccggatgactgctaagattatcacagcataaggaggtgggatgattaactccgaactggtagatagtggtgtgaagcttgcgccacctgcactcgtatcaggtgggtacttcctcggtatcagttgggataattgggtgttaatagcaacattcatttataccgtgttgcaaattggggactggttttataataagttcaagatttggagggagaagcgtgagcgtacacaataaacatgcagctacagaggacgaggttggcattctgcatggtgctattaccaaaatcttcaataagaaagcacaggcaatactggacactatagaagaagaccctgatgcagcattacatttagtgtctggtaaggatattggtgcgatgtgtaagtgggttcttgataacggcattaccgccacacctgctgcacagcaggaagagtccaagttatctaagcgcctcaaggctatccgagaggcatccagtggtaagataattcaattcactaaggaggattgatggctaaggcaagagaatcacaagcggaggctcttgccagatgggagatgctacaggagttacagcagacctttccttacacagcggaaggtttgcttctctttgcagatacagttattcataacttaattgcaggcaaccctcatctgattcgtatgcaggcggatatcttgaagttcctattctacggacacaagtaccgcctcatcgaagcgcctcgtggtatcgctaagacaacactatcagcaatctatacggtattccgtattattcatgaaccgcataagcgtatcatggttgtgtcccaaaacgccaagcgagcagaggaaatcgcaggttgggtagttaaaatcttccgtggcttagactttcttgagtttatgctgccggatatctacgctggggaccgtgcatccgttaaggcgtttgagattcattacaccctacgtggtagtgataagtctccttctgtatcctgttactcaatcgaagcaggtatgcagggtgctcgtgctgatattattctagcggatgacgtagagtcgatgcagaatgctcgtacggcagcgggccgtgccttgcttgaggaactgactaaggagtttgaatctatcaaccagtttggggatatcatttaccttggtacacctcagaacgtaaactctatctacaacaacctacctgctcgtggttactctgttcgtatctggactgcgcgttacccttcagtagagcaagagcaatgttatggcgacttccttgcacctatgattgttcaagatatgaaggacaacccagcacttcgctcagggtacgggttggatggtaatagtggtgcaccttgtgcccctgaaatgtatgatgatgaagtcctgattgagaaggaaatctctcagggtgctgctaagttccagcttcagttcatgcttaacactcgcatgatggatgctgacagatacccattacgcctgaacaatctaatcttcacctcgtttggtacagaggaagtccctgtgatgcctacgtggagtaatgattccataaacatcattggtgatgcacctaagtatggtaacaagcctacggatttcatgtacagacctgtagctcgcccatacgaatggggtgctgtctcccgcaagattatgtatattgaccctgcgggtggcggtaagaatggggatgagacgggtgtagccatcgtattcctgcacggtacattcatttatgtgtatcagtgctttggtgtacctggcggataccgagaatcgtccctgaatcgcattgtgcaggccgcaaagcaggctggtgttaaagaggtattcattgagaagaactttggtcatggcgcgtttgaggcggtaattaagccgtactttgaacgagagtggcctgtaactctggaagaggattacgccaccggacagaaagagttgcgtatcattgagacgctggagccgctcatggcagcccataggcttatcttcaatgcagagatggtgaagtcagactttgagtcggtacagcactatccgcttgaactacgcatgtcctacagtcttttcaatcaaatgtcgaacataacgattgagaagaacagcctccggcacgatgaccgcctagacgccctgtatggcgctatacggcaattaacttctcagatagactatgacgaggttacacggattaatcgcctcagagcgcaggagatgcgcgattacatccatgctatgaatacacctcatctacgcagggcaatgctatatggagattacggtactgagcgaagagtgaccaacacttccgtagcgatgcagcagcgagtttacgggcagaactaccgaaataaatcggcaagcagaaatacactttctgcaaggatttcaaggacttattaattactggacactatagaaggaaggcccagataataagagaaaataataggtaatatataggttaacctaggttatataggtatgccttagtatgggtgtactcctgtacaccctattccttactaccttactatatttacataataggagagagacaatggctaatgattatagtcgtcaaccattaacaggtaaatctaagagaaagcaggtacaacctgtaagtgaagaactaatgcttccggtaatcccaaaagaggcagctagtaagaaaagcaatgttattaatgatgccaccaaatcaggtaaacagaaaggggccatggtgtgccttgaagtggaagatggtgtattgaagattgctatcgcggttgatggcaaagaagattcagagtggaagttagtgacagtggaacccactgttaccccagcttaagagaaggaggatgttacatggctaaatatggtactacaggttctgttactggtcaggcttttcgagtaaaagcagtacaaactattgcaacggcaatcccgatgcctgttgttaaagaagcagaccttaagagtaaagaccaccctatcaacatcaaacatttatcaggtaaacagaaaggtgcaatggttgctcttgagaaaagtgacacaacattacatattgctgttgcacgtggtagtgaaccaacagacctttgggatgtaactggcatggaatcgctcgctgtcactccagcaggtggagaataatgcttaacaaatacttcaagcgtaaagagttcgcttgccgttgtgggtgcggtacatccactgttgatgctgaattactacaggtagtcacagatgtgcgtgagcactttggttctcctgtatttatcacttcgggtcatcgctgtgctaagcacaatgccaatgtaggtggcgctaagaactccatgcatcttactggtaaggctgctgacattaaagtgtctggcatattaccttctgaagtgcataagtatcttactagcaaataccaaggcaagtatggtatcggtaagtataactccttcactcacatcgatgtacgggatggttgtgcgcgatggtaagatgtgttgaatggtgtgagcgtatggttgcccaagctgccgaggatggcaactatgatgactggaagaactactctgacttgttagctcaatggaaagggagatgcaatgaaaaagctgtttaagtctaagaaggttgtaggtgcactggttgcacttgttattgctcttgtttctgtaggtcttggtgtagaccttggctctggcacggaatcctctgtgacagatgtggtctgccaagtgattacctgtgaataagtttctagaagtgctggcaggtcttattggcctgcttgtctctgctaagaagaaacaagaagagaaggaggcacaaagtgaagcgaatcatgttagtgacaacccttctgattggttcgctgaccacttccgggtgtcagcaggcgttaccagagaaagcaatggtgaaacctctgaggccgacgctgacggcagtttacgaggtagacgataaggtctgctttagtaagcctgacgctacaaaacttggtttgtacattctctcgctagaacgcggatacaattaatacatagctttatgtatcagtgtcttacgatttactggacactatagaagaggtaagatagcgccgttcttttgagcggactattactagccaatcttcatagggagggttggaaagtaataggagatagcatggctaaattaaccaaacctaatactgaaggaatcttgcataaaggacaatctttgtatgagtaccttgatgcgagagttttaacatcaaagccgtttggtgctgcaggtgacgccactactgatgatacggaggttatagctgcttcattaaactctcagaaagctgtcacagtctcagatggtgtattctctagctctggtattaatagtaattactgtaacttagacggcaggggtagtggcgtgctaagtcaccgttcaagtacaggcaactacttagtatttaacaatctacgtgcaggtcgcttaagtaatattacggtagaaagtaataaggcgactgatacaactcagggacagcaggtatcccttgctggtggaagtgatgttactgtaagtgacgttaacttctcaaacgttaaaggtactggtttcagtttaatcgcataccctaatgatgcgccaccggatggacttatgattaaaggcattcgaggtagctattccggctatgctactaataaggcagccggatgcgtacttgctgactcctcagttaactccctcatagataacgtcattgctaagaactaccctcagttcggagcagtagagttgaaaggtacagccagttacaacatagtcagtaatgttataggggcagattgccagcatgtaacttacaacggcactgaagggccaatagctccctctaataaccttatcaatggggtagtggctaataatcctaagtatgcagcggttgttgcaggcaaaggaagtacgaacttaatctcagacgtgctcgtagattactcaacttctgatgctaggcaggctcatggtgttacagtagagggttctgataacgtcataaataatgtgcttatgtcaggatgtgatggtactaactctttaggacaaaggcagactgctacaattgcacgctttataggtacagctaataacaactatgcgtctgtatttcctagctacagtgctacaggtgttattactttcgaatccggatctacccgtaacttcgtagaggtaaagcaccctggcaggagaaacgaccttctcagttctgctagtactattgacggtgcagctactattgacggcactaataatagtaacgtagtgcacgcacctgccttagggcagtacataggtagtatgtcaggtaggttcgaatggcggattaagtccatgtcactcccttcaggagttcttacttctgctgataagtacagaatgcttggggatggtgctgtgtcattagctgtaggtgggggcacttcttctcaagttcgcctatttacttctgatggcacttctcggacagtggccctcaccaacggtgacgtgcgtctttctaccagtagcacaggctatttgcagttaggtgctgatgcaatgaccccagatagtactggtacatacgcattaggttccgccagtcgagcatggtctggcggttttactcaagcagcattcactgttacctcagatgctcggtgtaaaacagaacctcttactatctcagatgccttactggatgcttggtctgaagttgactttgtgcagtttcagtatttggatcgtgttgaggagaaaggtgcagactcagctagatggcacttcggtatcatcgctcagcgagctaaggaggctttcgaacgtcacggtatagatgcacatcgctatggcttcttgtgcttcgacagttgggatgatgtatacgaggaagatgccaatggctctcgtaaactgattacaccagcaggttcccgctacggtattcgttacgaggaagtactgatattagaggctgcgttgatgcggcggactattaagcgtatgcaggaagcactagcttccctgcctaagtaagcaacaggcagtgcgtaagcactgcttttagcgcaacttttcttaaaggttatcacgatggtagcctttcagaaaaggaggttacatgattcaaagactaggttcttcattagttaaattcaagagtaaaatagcaggtgcaatctggcgtaacttggatgacaagctcaccgaggttgtatcgcttaaagattttggagccaaaggtgatggtaagacaaacgaccaagatgcagtaaatgcagcgatggcttcaggtaagagaattgacggtgctggtgctacttacaaagtatcatctttacctgatatggagcgattctataacacccgcttcgtatgggaacgtttagcaggtcaacctctttactatgtgagtaaaggttttatcaatggtgaactatataaaatcacggataacccttattacaatgcttggcctcaagacaaagcgtttgtatatgagaacgtgatatatgcaccttacatgggtagtgaccgtcatggtgttagtcgtctgcatgtatcatgggttaagtctggtgacgatggtcaaacatggtctactccagagtggttaactgatctgcatccagattaccctacagtgaactatcattgtatgagtatgggtgtatgtcgcaaccgtctgtttgccatgattgaaacacgtactttagccaagaacgaactaaccaattgtgcattgtgggatcgccctatgtctcgtagtctgcatcttactggtggtatcactaaggctgcaaatcagcaatatgcaacaatacatgtaccagatcacggactactcgtgggcgattttgttaacttctctaattctgcggtaacaggtgtatcaggtgatatgactgttgcaacagtaatagataaggataacttcacggttcttacacctaaccagcagacttcagatttgaataacgatggaaagagttggcacatgggtacttctttccataagtctccatggcgtaagacagatcttggtctaatccctagtgtcacagaggtgcatagctttgctactattgataacaatggctttgttatgggctatcatcaaggtgatgtagctacacgagaagttggtcttttctacttccctgatgctttcaatagcccatctaattatgttcgtcgtcagataccagctgagtatgaaccagatgcggcagagccatgcatcaagtactatgacggtgtattataccttatcactcgtggtactcgtggggacagacttggaagctctttgcatcgtagtagagatataggtcaaacttgggagtcactaagatttccacataatgttcatcatactactttaccatttgctaaggtaggagatgaccttattatgtttggttcagaacgtgcagaaaatgaatgggaagcaggtgcaccagatgatcgttacaaggcatcttatcctcgtaccttctatgcacgcttgaatgtaaacaagtggaatgcagatgacattgaatgggttaacatcacagaccaaatctatcagggtgacattgtgaactctagtgtaggtgtaggttcggtagtagttaaagacagctacatttactatatctttggtggcgaaaaccatttcaacccaatgacttatggtgacaacaaagataaagacccatttaaaggtcatggacaccctactgatatatactgctataagatgcagattgcaaatgacaatcgtgtatctcgtaagtttacatatggtgcaactcctggtcaggctatacctactttcatgggtactgatggaatacgaaatatccctgcacctttgtatttctcagataacattgttacagaggatactaaagttggacacttaacacttaaagcaagcacaagttccaatatacgatctgaagtgcagatggaaggtgaatatggctttattggcaagtctgttccaaaggacaacccaactggtcaacgtttgattatttgtggtggagaagcgacttcgtcctcttcaggtgcacagataactttgcacggctctaattcaagtaatgctaatcgtatcacttataacggaaatgagcacctattccaaggtgcaccaatcatgcctgctgtagataaccagtttgctgctggtggacctagtaaccgattcactaccatctacctaggtagtgaccctgttacaacttcagatgctgaccacaagtacagtatctctagtattaataccaaggtgttaaaggcttggagcagggttggttttaaacagtatggtttgaatagtgaagcagagaggaaccttgatagcatacacttcggtgtcttggctcagggtattgtagctgcttttgaagctgaaggtttggatgccattaagtatggaattgtgtccttcgaagaaggtaggtacggtgtgaggtatagtgaagttctaatactagaggctgcttatactcgttatcgtttagacaagttagaggagatgtatgccactaataaaatcagttaagcaagctgctgtactccagaacacagaagagcttattcaatcaggacgtgaccctaagcaggcttatgccattgctaaggatgtacaacgtcgtgccatgaagaaaccttctgcatcttctgcgtaagcaggttaatatcttagtgtacacaagggcaggcttaggtctgctcttagtgtatccaaaggaggtaacatgatttggattcatacgtatggtgtaggtccattccagaagaatgtactcaggaagattcatgagtccgaggagtcggccttagccagccagaaggtacttggtgggactatccagtgctacatgaagaagccacaaggtttcgacttagtgtaaccataggtggtcacaaagtaaccaaagtcaaaattttgatataggcgtgtgtcagctctctcgccctcgccgggttgcccccccccccatagggtggcctgagggaatccgtcttcgacgggcagggctgatgtactccttggatagtacaagggaggccgagggggcgcctaggacggcctagggaatggcttagtggtggacaaggtgattaccttagtgaagcctcttagtgcattcctgaggccattcagggcgtttattagggattgacagggtgggagagcgtgggcta

SEQ ID NO: 21 - DNA, 150995 bp, Unknown
  Myo, Distinct clade
gggcgcaccaagcgccctttctttttacatgtagaggataaacaaaaatgactttaaacgagcttaaaacagcctataacgcaacattaaaaatagccgtgcgttaccgtgacgaatacggttttattgcgcagggtgtgatcctgggcttttctgacgatggtttgatctatgttgatgcacatcacaacaaggttaaacctgaaaacgtcattagcataaaatatctttaaaaacgcttgacaccataaccaggtaggataagatgtatcacatagggcgggaatagttcccgaccacataaaagagaaaaacattatgaccactatcacaacaaaacaagaaaaaattattacagacattgccgcagtagccgctattgctattatcggtacctactatgacaccgcgcgtccttcctccttgcatgagatcgccgccgttgcatcagttggcgtgctgttttacgttggtaaacgttatttatcaccaatgattaacaagctgacaccgtggaaaaataaaggttgatcctgttttacattgtgttatagttatcgtgtagggcggcaatggtgccgcgcccctttgaggatgcaatcatgagtaaagctaacaccgtgctaatgttttccctgattaatgatcccgcttacttgtccaacatgacgcaggagggtaacacattaacggcaacattcaccaataagcttgaccgagtgatcatcatctcactgaaaacagttagtaaaggcttttactcgttagcttatcattggatcactgataccgacgagacaagccaggactatagcgcccctttccctgaatcaatggcacgggagatcatcgccgccgttgtaaatgatggtttgtttactgcataaataatttagaaaaaggcttgcaatcattttgagatagtgtatatttaattcatagggcggcgggaatagttcccaaagcaaacgagaggattacacgatgagcaagtacacagtagaatacacggtagagaatccggtagtatccgaaggtaaaaagatgacatttgccatcagtataatcgctttcgttgtcactatcttatcaatcatcttataaggtgcacaccatgaaaataacagacattatcaaagagatcgcccttgccgctggcgttgaagtcgaggaagtgatcgcgctcaatcttacagaaaacgatctgcgcaactatgaagcggaaagcgtgaaagcaagcggcgcggtcctggtatatgatccggctaacaagtaaggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcgtagtctgataatatgtatcttgtagcgcggcaatggtgccgctcacaagaagagagaaaaatcatgaaaattacaaaaagcctaactaattatgcagcacgtcgcggattatgcttaaccgttgaaaacttagggaaagaagactttttgtgtttttgggagcttgagaatgattgcgagtggatgttttcttattctatctgcgaagatcaaaacggttgtttgttaacctggcgcggtaatatctatttaccggaagaaattaaagaagagttaccaggtacgatcatgacagagagacagcttaaagaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaacatcactgtaaccgatgaaaacggcattgaatactataacggcgacgatgaagaataattaatgaggcgggggagtattccccgccgtcaatagggcggggcaataaggcaacgcccactaatgagggtaaaatcatgttagagaaaattttcacggttgtagtagtgggcctggtgttatcggttggagtggttgcaactatggctaacatgatcctatcttcccacggtattggataaggtgaatcaaatgatcacgaataagacaggtaaaacagaatttttacgcggcttgcagatcggcaagcctgagatctggcattgcactaaatccgcgcataatgaaatgaaagattttaccgctactttacaacgtgttaaaatatctataacacagaaaaaagccttgttagtagtagaaaacgagatcccgcaaactattattattgtcgagcgtacagcatgaaaacagaaatcattattgaaatcatcaacggttataaagaagcctttatttttgctgaatcagccagggatcatgaaggtaattttattgataacttagacgattatgatttttctcctagcgcggacgaacggatcgcccaggatgtaacagcctttattaatgctaatcttgccgctatttctgaggcaatgagcgacggcgcaacagccaaccagatcgggaatgatttacattttacccgtaacagtcacggcgtaggcttttgggatcgccctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaaactggttgttggtgatgtattcgcgttaatggtgcctaacagcagcaaactgggcgcttatgaagtgatggatcataaaaatgaatcatttggcgacggttgcacaatggcggtaaaatccttaaaggatggaatcatccgtcaagctaattggcacaaagggaatcaagtcggattaatatcagctaatttcttgccagaagagcaaacgttagaccaactatcaggcggtaagacgttagccgaactactggaaacagcgatctaatcaacaaaggggcggcaacgccccacatcagaaaggaaaagattatgagtattgcaacagtattaaccgccgttaaaaccgctgaatcatccggcttgcatgttgagcttatagatcaaccaggtggcgatctccttgtccaggtttacccgccgaaagtaggagatgattattattggtgctattctgatacgttcgaacaagtagacacgaaagcgatcacggcttttattttaaaagctgttgaagaaaataactttcattataacatcaatcaataaactttaagcaggggcggtaacgccctattaaacgcaataggaagaggatagaaagcatgaaaaagatgatcgcagtagttgccctggttgttggtattaacgcgcctgcaatggctaatgatttgcctgaatccatcacgttaaccgatatcaacgcggtaaaccggatcggtgttaattatcgcctatgccttgccgctaaaactttccaggacggcacgacagaataccacggattcgagggtatccgctgcggtgagcttgcacgcgaccttaaggaagatccagaccttgaggccataccgatgaccgtaaacggtaaagcttacgtaaaccgccaacaatgagaaaggtaatcatgacaatggggatcatagtagcaacgctggcgctgatccccttcctggttgaatatgtgctgattagtgttgtcctggtagtcagtgacttattggaaacggttggcacctggttttaaggaataataaaatgaatacagaacaagttagaaaggtattagcagcgttgcggtatcacaaccatagcaaggtaaagaatgatcctgattatgtggattcaagcctggaagaagacacattgcaagctataagccacatgcaagaattgcttaaacgtatgacagagaagaacagatccgactttataggtgaggaagtataaaacagcttgcacgatgtgccggatagtgtaagatgtatttcgtagggcggcaatggtgccgctcacaactggaaggaaaacaccatgactacagctaaccgcctgatcgccgtcctgaataaagcaaaggctaaccgcctggatgttcaaatcaaagagcaagcaaatggcgagatccttgctacggtgtccgatggcggttatgtatcagaatcatttttatcagggagcttagatcatcttgtttggaaattagaaattatcgtggaggatatgcagatcatctaatctttacaaaaacagggcttgcttttgtcctgttttttgttatgcttattgaacgggcggcacctggcgacaggggaagataatcaccggaagaccccgctatatattgatagctaacacctatcaaacaacaaaacatcaaagagataaactatcaaatctttacaattccacctattgacaccggatcacgcttacattattatttatcacgtagggcgagcaatacagcaagcccacaaagaggaaaagaagatgagcaaatcagcaattaaagcagttgaaaaagcgcaagaagtgatcgcaacgtcaaccactggcgcaaaggttaatctcgttggttatctgacagatgaaactatccgtaaaaattggcgtaatgctgatttactggcttgcttattgattaatagtgtcgctaatgctttccagtgtgaaacagccgagagcatggaggaaaacttgtttgataatatggatcaagccattgaaacctatatacaatcaaacctggatagctggaacagtaaaacatggcccgacaatttacgcgatacaactgatcaactgatccgccttgccctgatggttgaacgcgataacgttcacaaccgcacaaagtaagattatacaaggggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccggtaaacgatgttaaaagccgtttacaatgccgcatggatgttaccgcatatcagcttgatccggtccgtgtagttgccctggtattagaggaagagatcaaagcaatgcatcatagtaataagtttattggtgacgcgcaggataatatgaacgtttgccgccataaagttaatgaagccttgaaagaatgcggttttaaggatctgatgattaaacgtgatgaaaaattccgctttcgtaatgacctggcaaaccggatctactcaatctatgaagcgttataattgacaacaaaacaaggggcgcaccaagcgccctttctttttgcctgaataatgttgatagattccgcctatggaaaacagacacagaacaaaactgaataaatagcggtatcgagctaatcaaccattaaacgaataaccatacctcccagggtaacaggctgttagagagccatttagagcggttaaaatcgatcaacaaccaacaacaaaccatcaaaaacacccttttacctcctttctagtgcaatgataaccattatcatctatccatgtttatctatgcaatataagtgcataactataatgttgataatagttcgcaacaactaactaaccaacaacctaaaacaataagcaaactaatcataatcaaaggaataatagcaagatgattgataacgacaaacaatcaaaccatgatgaatactaagcaagataacgataacacgacaaaacaaccaactaacgaacaataacaaacgaaaccattaaaataacaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacattagcgcaataacaataatcattgtggtaattacaagatgaaatcattagcatggcaataattatgggggcaatgggaggatgattatcatcattccgatacattgcacactatgcacataatagaataaaaggcaatacttttgggggcgaaatgttaccgccacaggcgggaatgttgagcactaagagaagagcaaatatcatgggggcgaatactatcgctacgcgatatgttgagcatcttctcttaaacgtaaataaaatcagaataatcttgatttattttagtttttatgttaataaacgtttaaataataatcattctcatataaataatagtctgcttgtcatgagcgggatcagttgacaatgttccgtcatatgatgaagttgccaaaccattgataaataagtgtttgtgtgatttataatcaagtggcccaccttgtcgctatgttggcataagccttgcataagtcattgaatacgaatgataattattctcattcgcatgatatttgggaattgtcgctgcgtggacctgacggcccgaaaattcgcgttaagcacttcttacgtatgcgccatgatttttgccatatcatattgattctattagatattcttgccatgattgccatgaaacagggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattatcatgcaagagagtaaaaatgttccgttgagtagtttacgtctaatgaagttttacaaagcttggcttgctggtgaggtagaaggtcacacaacgagtggtttgtgcatatgtttgattaagtatgtagagggaacatatcctgatgaactgttacctcgtctacaacaggagatgaaatcacagtttattggtgcaggactggattacaatttcccgtttaatgaaggtggttatgaggaatacaccttcgaacataaaaaacatatttgccataaaaacaaacatcgtatacaatgggtgctagatagaattcaagattacgaaggagagaaaaatgacaaatagtattccgttgagcagtgcaacattgcttcgcttctataaagcatggattgccaactatcctgcaatgaatcgcacaacgagtggcttatgtggttgtctggtagattatgtaaacgattttgttggtgagacaactagagaagaagatagaagatggcgggatagtttgttggaccgtttgaaatatgaaatgaggaaacaatttacatgtgcagggttggactacaatcttccgttcaatgcagattgcatggattacctttcagagtgtataaacttggcgtgtcataccaacacgttacgtcttcaatgggtgaaagacagaattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactgtaagccgtccgttgtgacaggcagtgaaacgtgtgttatcgatttcattaacgaatacttccgagggaatccggttagtcgttacttcattaagggtctgaaggatgcataacatgaaacgcatgaaaattcgtattgagaatgatggtggttataaaggattggcacatgcaaaatttccacttgtgttggaagccatggtggaatacagtgggcttgctcatgtgcgattctcgaagatgatggaagtgcaggaatggttttgggacgagatagatgcacgagaaggggaagattatgttttctttcctcacgaatataacattgtttattaaaggttgtgtgcaatgatcacaccacaacagaatgaagcagcaatggatcttcttgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgcgtttccattttcaataaaatgttagcattatggggaggtagaaaatgagacaattcactatactggcagcttatgtgcaatgtgttcacgattatgttagtgctcatacaggtttgctggaagttaatagtaaaattgaaggcaatatgggtactgtctatgtgcaacatactttatccaatgtgccgtttaaagtgttcactgttgtagctgccgattacaatcgtgtagatgtgcgtttcttggatcataattttcgtaacgcactagataatatcgaagattatcttcccgtgaaacctttgtcatttccaccgagtcgtgcaaataatgtagtgacaaaccttaatgaaaggaatgtggctatgcacaaaaaagtccgtcaactgaaaacgctgatggaaatgcaagaagagattgaaaaagaactaaaagaagattttggtatgcttccaaaagacgctttgaaatggtatgatgaactaggaggagaaagttatgaataaaggaactactgtatatttagtaacaaagaataccccaggctggagccaatgcagcactgtcccttacaagatctgtgcaacattagaactagcacaacgtgcagaagcagaagtggatgccatgcaatacagctatggtgagatcattccttttactcttgaacaagaaggagcatacaatgtttaaagaaggtcatgtctaccgtttccaggatgaggattatatgcgactatattctacctttgataacagtattgctgctatcattggagagaattttttcgaggtgttgagcactgatgcaaatggtaatatcttgtcaattgttgtgatagggagagacggtattatcactgctagtgatggggatcgttacataatcaattctgctcatatagattattttgttgacggtggtattcgcggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtttggttgttgctaccatcggcgtatcttttgtttaaaaggggaatgttatgtttaaagttaatgctgtttactgtttcaaaactaaagctgcccgtgaagctttctctatgatctctgatgaaaatttcaaaatggcagctttgattgaagggtcttgtttccgcgtcgaagatattagtgaatcaggctctgtttgctcattgactttattggacagcggggatattattgaagctggacagtatccgttcagaagttgggggatattgttagctcgcggagagcgtaacttttttatgtgcgtgtctgcggaggaagttgtgaaagaaactaaggatgtttctgtttacaattctgaatttataagttatagtgagtatcaacatctggaaggcattgttggtcacttgttatctctgattaacgttgaatgtgacctgcctgaatcattgaaagaagagttgaaagcattagatctgttataatgtttcgcacaacgaaaggagaataagatgaatctgaccgaacagttacgccgtattgcaaaagaagcttccttcaacttccctgttgaagaagtgattgagacatgttttgctgaagcacgagcgggaaactcttcaagaaatttcacgccatctgattttggtctggataattcccctacccacccaggggagatctacaatcaggtgaagtggatggatgaagcagtagcaattcttcgtgagcgtgggcttattgtttataaagaaatggatctgaacggggcatacgagtggatcactgttgattggtccgaggtgaaatgatgaaaggtaacaagatgaaagttaatcaagtgccgagcgcatacactttatggcttgcgcgagcgttacaccagacgatcaaagaccctaagaagccaatgaagagtgggaagaagtttatgtctaagggcaaaacaacctttggcttcactcgtatgtctgtcaagatgaaaaggctggggtacaagccaaactacgctcgttacccttctgaatacaactggtttgactaaaaggagaaagactatggctacttttcaacaactgaaagatgtttcacgtttagtaagaaaaatccgagaagcagacgctgctgtgcggaatgcattaacgccagcagagcgtgaagatcttgaagaggaggtgaaaacagccgagaatgcttttgctgcgtatctttcaacactgtatacaggaggttaaatgtcagaagaacttaaagaattttatcaagcatatcataactggctgttagctggtgctccagataataatcctttctggcatgataaaggattatgtagttgcctctacctttggactggaggttatgatgatctaaattatgaaatgcaaatgcaattccgtgaggcaggattatctgaagaatatccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttagtaattgttatggttgttcttttcgcggcatggctttgggattttgacccaggagcagcgcagcaaagagctacagactggaaagaacaatgtattgtgctcaaacatgaacgaaatgcggagaaatttcttgacctagagtgtgatcgccttgtaagatacaagcaagataaataaccttgaggtgcaaaatggtaattgagattaaacttgaatatgctggggctgttgccctgatcgcacaaacgttgggagcaaagattgaagaagtgtgtatcaatgcctggagtgtagagattgatgttcctatggacaacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagcgatgacatgacaacattctttgttacgatagaagaaatgtccaaagttgagggatgggagtggtttgaagaagatgtttgggaaggttgtgattacgtatttttctctgatgaagtgaatgttctttcggagtaggtatgtcttgttttacaaaagcagtgtccatatgtaagaaacagtatgaaagtgattacggaatatttaatattccagtggatcatacaaagtattgttcatgtggtggcagaatgaagaaaacagtgatttatgcggatagtggagacgaacttgttccggttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttattgttactcattgcatcactcggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggtggtgctttgatgagtggcattctgcaatacacaggagaaaaaagtaaagatggtagtgctatgtatggttcacaacagtttattggcactactgaagttgtgatgatgcgcacagagtatcgagacactttagcttggtttgcatttctaaaaaatgataaaacaataacgaatgttcttactctagaagctgattgtacgcaacgataagggggatttatgactaaaatgagacattacgctgtaaactgcaacgatgcttggcgtttgtgtcctgatgatccgacagaaggtacatttgtaagatatgaggattataaagagttatcggatgctgtaatcgcattgttaactgatatccgttcacgttatccaggacaagatttcacttgccctcacatcaaacttcttgcttgcctggtagaaggtgagaaagaagtggaagatggcttcaagcgtgtagagtatcaaggtgaaactttagatgttcctgaatttgttaattatattgcaacagattcaagtggcgagcgttatggttacactcataaaccggagattccagatttcgcttatgcgtggcgtattccttatgaagtttttaatgttgcagattgctggtatttaggagaaggaaacaaccttaattggcgtgattccttggttcaggtttaacaatatgaaagagacattgccagcagcataccgtttgaatgatgaacgtatttgggagtggaccgacgtttcttgtttttaccctgaaatagttcaatattggcgagcaaaagggtgtgttgtagttatcaacccatgtggaccagtggatgaagattgcttgtatctcgatggaaagtggcacagttattgtcgctggccttttgagtggatgtgtaaagaagatctcccagagggttgggagtatccaaaagcaaataggagataatatgtctgaagattttgttgaagtgtttgtcaaagacgaagaaactggtttaggcacaggtttcatttgtgaagaaacctttaaacgtgaacaagaaaaagctattcttatgcgaaactatgatcacgcattagaacaatggaaaaatgcagaacaaaaatgcaaaaacctttatgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttctatgttaaacagaagtctgtagaaggagagaagtgatggaagaaaaactggaacgtattatcgagttagccatgtctattggctacgacgattgttttctccaaactattggagaaacagagaacgattacgactcttgggtgaaagagttggaagaacttaaaacttccttgattgctgactttgctgaagcagaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagggattctcgttccctctgtttaaagttcagaagcttagaacgcgcaaacaaagagcaagaaaaactaacgaggtggctaaatgaaaacaagcgcaaggttgatggagttttataaaatttatttagcatggattgatgttggtgctcctgatggtaaaccttttcggcgggattgcggtttgtgtgccaacttattcgactatgtgcacgcggatggctacaatccccttataacaaccttgtcagatgaaatgcacgcacagttttaccacaaagggttgagtcaagaattacccttcaatgagaactacgatgcatatgtcttagaatcagatgcagaggtatgtcacctgaatgtggatcgtgtgaactgggtaaaagaacgtgtagcagaagaaataattggttgacagagggatctgtctttgtcataatcatctcatcgaaacagagaggagagaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccatttgctttagaaggagatgcttgggactgggctgaactcaatccttgttgtgaggaagaagaatctatgttcttaggtttaaacgtttaccgtgtagattacaccatgtgcggagcggaacattctgttcgcgtagaagccgaatccaagctacaagcacctttcaaggcgggattgactttgggtcattgtttggcaaacattgaagatgttgtgatccaaagagttgttttagagaaagaggctatttgacagaaaacggtgcaatatttaaaatataaagattaaccacaaaaggagagaaaatgcaagttgaagacctgatccagattctgaatagagccaaagagaagggtgctatcaaagactggaaacgtgaaacgagtgaagacctatctcactgttgccgagaattttacatcgaaggtattgctgacgatcattatactatcgaatggtatatcaacttaatgacccttaagcacggttcatttgagatttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatccttcttgttagctggtttaggaggtgttctcataggtttggctcttatctggtgtattcgtcgattaatcgggtaccgacaaaaaggtgtttcatgttttgtatcttacaattttacaactgcttacagcaatgaagttggatctggcaatgctcaagcatttttaccaacatatcctcctacggtggaagatattcgaaacttggaagtagaacttatgggactaagtgataactatacatctctagttattcaaaatatttttcgactaaaacaggaggcgtgaatgaaggtacattaccctcatccctttgatcctaaaaacaaagccgtaattcttcgtcagtggcaacgggtttgtcgtactaaatgtccaatcaatagcccacacaatgtagacaaggactatcttggtacatttgttgaatacacttacatagacaaaaacaagcgtaaacaacatgtcgaggaatactgcttaagagtagaatggctgtaaataataaataccttgacaagtgtttattcgttttgtaaagtgggaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctctgtagcaactcttctagagatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaagggaaaatggaatacaactctgttaaagcagacgcttttgcagagacattccgtgaacgcttggagatccttagagatttaaatacaccttacaaaactattgctgaaaaattcaatagtaagaaaatagcaacagcacgtggtggtaaatgggatgctaaaactgtttctcgtttgtgtgccagactgaacattaaataggagaggatatgaaacaagaaaatgaatctgtagatcacttaatcatgctgtcagccctttttgccggatgggacgtattttttgaaaatttgttcaattcttctacagatggttccgattttatgcgccagtttaaacgacgaactgttgaggactatgctttctattcaggtcggattgaaaaaggttacgaagatacaaatacaacactcaccattaaagttttagatgtgatgtttagtgttatagatgctatcgacgaaagtcttccgatcctagacaattgtaatacgaaagcctatgtttacaaaatagctcgtgcttatgtgtctgcaaacagttgtcttctttccacccagattgccgtgaacaatcttgccaacttgtttgatgaaggagaaactttttatgacaatcgatttgaagtgtaagaggattcttttagatttctataataattggttagaacacctccgtctctttccaagagaaagtggttacgctgatgttggcttatgccgaggtctgcgtatgtatataagtgatgaatttcgggcagagcattctttagcatattctgtttatggtatgcaattagccagttttgaaaacgctggcttagatacaactttcccatttaacacagcaaaatcttttgatcaagagtgtaaggaaaaactttgcatgtttaatgaaaaacgtgtacagtgggttaaggatcgagttaaacaactggaacaagagttggatttcttctatgatgaggcagaataatggatagacaaaccttaaaaacaatggcagatgccactaattccccgtactttgaaaaagtaagtaaattggtagctcaagccgcagaggaaggatattataacataaacatccataacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttgggacaatttactgtaggggaaacataccctgtcattaaacataatcctaacatcgcaaactttgataggatggttcttgttgaggacgatctgggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctattcctaaagaaggcaccgaagttgaagttattgcacatcgcacaacttcgcatggtaacgatgtagcagttgttttctgggatgatgaaggcgctgcttgtgcaggtggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatattgtataacttttttaaaggttggttgaaatgggcggaacaagctcctgtcggagattgtgtttttccttgggattctcgtcaaggcttgtgtcgttgtttggaagattggcttataaccacaaactacaattcagaaactaagaaatctacatcaaacagattaaaaatgttgtttgaagaagatggtttagatccaatttatcctttcggtgaggaaagtttccacaatggtcttttccttggcactcaacattatgataaagatcgtgtagattgggtaaaagaaaaggtagcacagtatgaatggggttaagaattatcaccgctggttagaaagctatcttaagaaatgtgaacttggtgttccaggttatacttacgacacggacgagatccttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaatgtttcggttgggacttttattactaaacgtcaagcagaacaagtaagagatactttaaacaagtaaatttttaagggggacttatgttaggtaagatcaaagcttttttcaaacgtattgttgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacaggcttgcagctatagcattgcttcgtggggagtatgactattgtttatcagcgccttgtaaaaagcatctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttgttgttggatgttggttgggttcttctgttgtgatgggagaatggttaacatacaatgtatttgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataaatcttacctatcaatctaactcttaactagtattgcacctatagtaagactattcctatagttattaaccctcttcttctgtagaatgtaattagatccttgacaaactcacaaagcttgtgttacattgtgtctcacaagtgaataatactgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcgcaaattttagagcaaataacccctccatacctatattcaaatgttgagcgttttaacgatgcacttggtctgacattaatagcggagtggtaataatggcgaaaatgttagcaattgatgatgttgtaacaattactacgtccataccttgtcctcctatgccttgcccctattgtggtggttcagggtatgttatggcggatgtaggtcaaatctacgagtgtaatccgtgcaaaaccacgggttatatccaaatagaatcagaggagaaacactatgagccaaaacgctaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggcgagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaagatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgctggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatgcagtcatctggaagttgttttggtatacctcgttggttttttgattctatcaaaaattctactacagagggatcagactatgatcaagatgacatgctttggttcttaaaaaaccgagagattgttctctcaccacttaaataaggagaaataatggtttcatttatcgtaggtgtagttgtaggctatctgattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaaaatgggacaaaagattgccccacaatcgtaacaaaagctgaatatgagaagtttttctacgctaaggcttgacacaggaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcatcgagttatacgagagagcactgcacaagtaagctagaacccacctaaatcgaacagagacgctctaaaatagaaaaggcacccacttgggtgcctttgttttattcttcgttagattgcgtctcagacgcgttaaattcggtttcagtacaacttgctaggtaacttatattttgcatcactacaactacaggtgtttgaagtttatcttctagccccgcagccacttgagccaaggcattatcaatatttgatttcctaacgcctgttccatgtcctgttgccaagtaaagattaccttcccctttttgtgtagcattagcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatattaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacacccgcttgttccagaagatcatctacgtttgtcgtgatgttgataacacgatcacagccgtactcttgaaaccattccgcgatctggtaatgcgcagcgttaggagacacactatccatctctacgcgacgtttattgtagaagtcatgagttttacggtagaggttgtatccctctgcatctaatccaccaacagcgccaggaacacactgttcttgctggtagccagcacggaaattgaaaatgtcacacacttcagaaaggtcgtattcatcccacaaagctttaccactttctgtgtcagtgcggaaagtacgaataccgctatcggcgcttaagccagcgccgctaatcactattaatcgtcttggcattcttcctcctcaaatggatcataagaatcgtactcgtaagtatcatcttctgaaaattctacttcgaaataaatatcaaactctgcaaacagacgtaggatgttagacatgctgtaataattatcgtaggcagattcagcttcatagtaaacataaagcaaatggttagccttatcatcttccaaatatttcccgtctgcatacgcatagtctgcatatgctttacctgcatcttccacaagagaacgatcaagcagagtaggaaatggtttctctttttcttttagtttgctcaccaaccaatgtgcaatatcattccattctgcatccataccactaaagcaacttgcttcttctccaaaagaagcttctcctaaatcgccactaatacgaacaacattagatgaactatagccacacgtttcacaatcagagtaactattatgcacattgacatttacttgaaacatattccctcctataaaagaaaagccccctgaaacaggaggctttgttcagatatcggcactataccagactttgaaggtatttgtcaagtgcttcttgatcaccttgacaaacatagcaacggaagtcttgagcagaaggttctttgtcctcgtcccaatcccaatagacagtacctttatagcgtgagcctgggaactcgaagtatgccacatgagtaatatggtgtgggccaccccaaaactctgtaaaagtaaattgaggatacgctgctttaactgtattttcaaaccaagttttacgatctaatgcttcgtttataaaataagcatggcgttccatttcatcccacgttttccagacacttctctcatcaggagaaaagacaagccattctggaaggtagagagtgtcatagtaatcatcatattcgatctcggagacgcacgaagctgactcctccagttttgagtaatcaaaagcagaatatacccaccaaccatcttccagtaacgctttgatagggacgaagcctttatcagcatattgatcgaattgtttgacacggtggcttgtgcagtcttcaaactcacattctaaacgatatgcaccttttcgacgagcctcaagaccgtgtgcactgaaaataacaacacttccttcaccatcattacgatctacttgataagcaactacttgttttgaatttgacattatttctccttatctagaagattgttagacaaaaacactgcacgagcaaaaccacgtgcggttaaggatctaagttgttttgtttttgcactagctccacctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatactcataaggatcaaagtaaaaatcgggtttacgccataaggttgaaagtttacctactgggttctcaatcatccaaggaacattatatttgttacccaaagcttccactacacgaatattagctaaagcttcatctagttcctctgtgctacgttcgtgtttgctaccactacctgctaacatagtgcaaggtggaaatccaaaaataatatcgggtttaggtatcccatgatcttcagggttgaatgtagaatctatccaggcattcacataggttatgtttgggtgctccatcctaacctcgtatttaccgtgatccccttcatcagcgtttacacaaaaacacttgtgacctgcttcggcataacgtaacaccataatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgctgagacattgttttatgccgtaaacctaaccaacaaggaacagatactttagtagtctttaatctgtgatcaacagtattagagtattcaataatagctgtcagtttcaatcgtgctttttctaaatcctcatgggtcactttgaaataactttctgaaagatatccacacatattaataacctccttcaaaaggcttaactacatgttgattagctttaaaacgttcaacatagtcgttttcgcccatgttttcatatagcttagtaacaacataaaagttttcccaagcatattccctaaaccaaccactagtgatggatgtgcagactttagataaagccattataaaactttgcttaggggttggacctccgatctcttcaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgctggagcatccattaacgcgattgcttcatggatagaatcatgatcataaacatacggaacctcgtcacctttaaagaagtctttactttttacgtttaagttcggatgagagtaagtgtatgtttctttctcacgtaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcatattccaaatgtgcaccagctatcattttgacgtggcctttgttccctttacgttctacaagttcaacaaactcgtcttgagagaacatttttgataattcttcccactcttgttctgtacacaggtaatctaaatctacacaagggcgatacaagtcttttcccatgtccatagcatgaatttgtaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacagagttcttcaatttccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcatcttctaagctaagaccaaaaccagcatcttcggcttcttttgtaagttcgtccactaaagccataatagcttgggctttttcagttaattcttcaatgttacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagcccacaattcagacattagagcatcaaagattaatcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggagagaaactgaaaccttcaccagtctcgtctgctaactgttctgcttccgctaaagcctcataagctgcttttacggcttcttctactgttttaaacttggtcgtcataaaatttctcctctcctaaagacatgttgacatgaaatgcgcggtatgtaaattcgttgtccgttgtgttagaataaaactcaaattgaacaacaccgtcttgagaagacaaatacatgccaatttgaactgttccttctggtaccaggtaagcatactctggacgtagtgttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacatctctccgaagaaaggcataagctttattaggtattgtagactcatatttaaccatatctggcacagcaaaagatactactactcctgctgggcttctgtcaagagccttattaatatttctaaggatatcgttagccaagatttctgccaattctccaagaacagtttcggttatatctttatatcccattaaatatttgttgatatctttcatctctgtattgttcagagtatagtctaaaggataaaaattcaaagaggagtcacttttatgtgtccacatgaaatgcacccgatccgagcagaatcgtaaccctctacgaagaatatcttctacaacagggagaatttcttttgtcacatcattaaccatgttgtaatctaagatttctgccaagtttgttctttgttcaccacgtttacgtctaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacatgatggagcaggattctccaaatctctgcctaacacttgatgcacattacgttggtgcaattttctagcaccctgcttaagcttttcataagctgggtgaacatctttgatccattgcacagagatagcatagttcattgtatctggttttgcaagaacaataacatcacctggaatctgattacctttgaaattttcccaaggaacataaatttccttgttagtaggattttcagactcttggacacctgtttcaaaagcagaatcactaccctctgccttaccagaccgtaatttaaacccaaggtttgaaagccatttccctatgcctaccatcaaagcccactcttcttcagatatgtccctacttccaactcctgtatagaacagttctgccataatcacctcaacaagtaatttcaaaaggtgtatagggttccgtatttctcataatccaaggactgctaggattgctcggatcataaggaccaaaaggttttatggtaggttgtgtttctttcttctgaatctcttcaaaaatacgacgaagttcagaatattcttgatccaccataagattcggtgcatctgattctacagtttgcaggttatcttccttaagaacaatctcacgaacaagattaacatcttctgtttctaagataacttctttacggatattacctacactttgaataattgtaattttatacattaatcctcctcaagagttgaataaaattgaagaccaccatccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaagatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaataccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacgatcagtaagatctcctaaagatacaaccacatctgtatctcggatacctaactttgcctttcctttttcatacagattataacaaccatgtagatctccaattataaaaagatcttgatcgcttttaacagtaatttctctatgtatgatcacttatcctcctcaaaatctaagaaaataaaaatattcacctttccttcaatctcttgttctaaaacaagatcggcaaattctgcataagctttctcttcaactttttcaatatgctctgcggcatctttaaaaggcgtatccccatccacctttactaataagaaaagagatcgcatttctacgcttttactgttacgaggaaggaaatctacagcttcaacaattctccaacccaaatagccaggggttttatgaatctctcctaaatacttttctaagattttacgaccctcgtcgataagggcttgttctgtagtaatttccattccttcctcctcaaattattaacgaaaccgcatgactaaatcttggttcagatataacctctgctacagtaacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccattaggtatcaatttcgcctcaacctggttaagtatgctttgagatggttttgttacataaaaaagattttctgttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggattctagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattagtcttcccagtcattgccctcggtagagtgaaccaaagctcgcacgataccgccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaacgattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatatcgggacgattttcccatttatgactaaaataatctttaccttcttcaagttcgcaatattctgaaccttcaggaaaatggcgataaatcgcttcagcttcacctctacaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataatcctatttgatcagcctctagaggataagtgtttttatctgtttttctagacagaatatcttcaacaaacttatcaatagccaaagaagaatcataaaattttaaaagttggtaatccataggagatattttgtcatctcttagaaatatttctaacatgttttcagtagtatcgtggtttagtgtatgttcaccaaaaatattaacttcgtaaacatctttgccaaaccaacgtttcttcttttcaacagtataggtttttgccaccagaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaagaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactgcaatcacgaacaagcagtgctttcttattaaacaaattacttaagaacagtaacttcgcctcttcttctgttatgtgcagaaggctaggatcggagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgtcattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatctccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggctataccatcggcttttacgcatgtttttacctgcttgagtataatatgcattgctgattaaagtcaagctattttgaaacccttcagcaccttttaaccccaactggaaaaccatgttgattattcccaatttacgagtatcactaaccttatcatagattggtgataagatagcactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcggacagaatttgtggaaatgtgcgtggaggaactccggtaagatcaacaactgttttagtcattgattctaaatcatagtcttgatcaagacttaaatattcaaactgtttattgcgcatggttaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcgctatataccgaggctgttcgaataatatatgcatttgggttaactcctcgcaccattttttcaccaagttctttcgtatacccataattgtttattgggttaggtgtagtatcttcaaaaataggatgagaataattaaaaatatagtctgtagaaatatgcacaaaatcaattttaagtttgctgcacactgccgcaatatttgcaggtccatacgcattaacagccaaagcagtagcaaaatcatgttctgctttatctacagccgtataagcggcgcaattaataacaccatctacataatcttcaataatagcgtttcgcacagcttcaaaatttgtaatatctacacgttctttaggataaattaaagatacatttgaaggagccactttacgtaaagcttgtcccagttgtccattaccgcccaataccagatatgttagcatacaccctcgctacgtaactgttgaaaagatttagccattgcatcttttgttgatagaataggtttaaaaccttcgtcaaaaatcatatcgaagccccaatcgatccctatatcaggatcatcccaacgtaaactttgttcactagaagggtcgtatggagttgtgcatttgtattcaaagatagcatccatactcaaaactataaaaccatgagccaaaccaggcggaagccaaaactgcgtatggtgtcgtgcacgaagaacaacaccgtcccaagcaccgtaagttggactatctttacgtaaatctacagcgaaatccaatacttccccacttacacaacgaactagcttaccttgcgggttatttgtttgaaagtgcattcctcgcaaaacaccgaagtttgatttagacatgttatcttgaacgaaagtttgtctaccaataatatcttcgtatttttgttcattatatgtttctagaaagaaaccacgatcatctttataaacgtctggtttgataattaccgcaccttcaatttttgttttttctactttcattttctctccgctaatttgagtaggtattgcccgtactctgttttcttcagtgagtttccatgatacaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttccacttgtaacttcctgtcttctaggtagctgcgattgatatcagtgatctccagttctccacgcgcggaaggggttacttctaatgcacgttgaataacagagttatcatagaaatacaaacctgtgacagcataatctgatttaggattttcaggtttctcttcaatagaaatagcttgacgattactcccaaattcaaccacaccgaatcgttcaggatctttcaccaaatacccgaaaatacaagctccgccccaaacatctaccatctcactggcgttaatcagtagtttaccaaagctttgtccgaagaataggttgtcacctaaaataagagcaacagagtcttctccgataaaatctttacctatgatgaaagcttccgcaagacctcgtggctcggattggattgcgtaagtgagttttatcccaaacatagacccatctccgagaagatactcaaagtcttcctgatcacctggtgtggtgatgattaaaatatccttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaattttctcactccaccattgagggttgtttaagtaccattcaatcgttgagtagagatcttgttcaaatgtagagtttgcactccagcccagttcagactctatcttagaaggattgatttcataacgcaagtcatgtcctttacgatcttcaacaaaagttatcaagttggaagaagggtaggttactgcttctggatgtacagtatccatatagtcacaaaccatatagatgatctccatattggttttgggattacgtgttccaacattatacgtttgacctggttctccacctgttgtcacttgaagaatagctcgcgcatgatcctcaacaaaaagccagtctcgcacctggtcgcctttaccatacaccggaatctctttattcgtcaagatacttgtgatgatttttgggatcagcttttctggatgttgataaggcccaaagttattggagcagttggttatcacaacaggcaaatcgtaggtgcggtgccaagctttcacaagatggtcagatgctgccttagacgcactgtacgggcttgaaggggcataagctgtctcttcggtaaagggaacgccagagtctgccatatcgccgtacacttcgtctgtggagacgtgtacgaacatcttcagtttattttttgggaggagccttgcagcttccaataaattgtatgtaccgataatattggagtcgatgaaaactcgtggattcttgatagaattatccacatgactttctgccgctaagtgaatgatgaagtcaggattgcactctactactaaacttttgacctgggtttcgtttgccaaatctgtcatgcttagtttaacgtgagtgatatcgcctacattctcaatatctgctgcatagcccatcttatcaacgacaaaaacttcgttattaggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccctctccgccttctaaatcaaggccatatatgcaataagactcatccgcatcgtagaaaggagagatgcggcttaagtccagaccttcttgtaagaaccagttaaaatctccatcaaattcttcttcaattctaggatcttctcctacagcctcttcccatttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcggacatattctttttcactctccatcttctacctccaacccttctttttcaaagattactactcgtccctcaccatgacaattcaggcaaggaaatgttaccataatttccacttccatctgtccagtcccaccgcacacaggacaaaaaataagtttttcagccattattcctccttaattatttcaaacttggcaacaccatttacaataatatgaccacaagacataactcctagccaaggatcgccgtttttcttcaggcgtttaccgaatacatcacaaaaaccattcttcatttcggaggcttcataagaagcccctttgtcaaaaacgtctttgaatgtgtcgattataccaacacatctcaaaatcattagaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcagcgttaagacctacaataaaacgaccttcactaaacaggtagtcacaccactgttcctcttgttcaacaacagtgtcgaggatcaaagtcaactcttcaatattgtcttcgtaaattttacgccaaattgggtcatgcatcaatgcatcaattacagcataatccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcagtcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcgttttcatcccaatcttgtgctttttgaagtttgtagagtttgtgcatttcagggtaagtcacgttgatagaatcaaaaatccccaactgttcccccatgaaaactggatatttacctgttttgtaagtctcgttatgtaaattaattgctgccatttaaatcctccactatttcacaaaaacctcttaagcttaaaatatcttcttcctcaaaatcattgctccggtagaaagcttccagtgcttcccatacgcttctaccaagtataacagtcactgtttcttcacttcttgcccttgttattgcgtaagccgtggcttctggataaaaagattcccaaatctgcatgttagctatttcaagaccgccaagataatggtgacaccaagtaggggtaaaatcttcagggcgaatcaacagaggcttaaacccaggtcggtagattggggttactccaggtaaaactataagtgtgctcataatcctcctcaataaaaaggggctgaagcccctagtttcatcacattttgcaagcttcacaaccaccatcagaatcttcttgtgctaaagagtctgctgattttgttctactgttaaggtaatacaatgacttgccacccagtctagcaaaattcagaataaactgcatctcagctttcactgataaacgtccacctaccaatttagaataatctagccaagaatcacaagaaattccttggtccgtaaacttggtaaagataccatacatttctgcaagatctttagccggagtgtcccaggcagactggtagaacattttcagtttttcatagtctggaacaataaataatacactacctttctgactttgtttatacataatagtatcacgaacaggatacagagagttagtagtattgcttaccaaactgctggactcattaggtgcaatagcagccaagacactgttacggataccaccttgttcaatgatttcagcacgtaagccttcccagtccattttaagatcaaaattaccgatactatctactgttttagcataagtgtcaattggtagccaaccttgaggccatttggtcttatcgatccattctgcattacctttttccttagccagacgcagagaggcttttgccaaccaaaagtaatgacgttctgcaagttcatgcattaattttttagcataagcgtctgaataatttacaaaattacttgccaaataatgcgctaagtttgtaatgcctacaccaatagatctacgtgctttagcagttatttcgttatgtttaaatggataatccattgtttcaataacgttgtcaattgtcaatacagtgtagtatgcaacatcctcatattcttcaggtaagacacgaccagcaacaatagaagataagaagcataaagccaattcttgattttctgtattctcaccagtaaagagatccggcatactgtggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaagtctggttcaagtatggtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatggctaaagactctgccgtatcgtctgcacggaacaaacaacaagacgcacttcctttgattggagttcgtagagttgtcagatacggcgatggcagattaatcttaagatcgctaacataagtataaagttttttaatatcttctatacggcgttcttttggttggatctccataaccttcattgcgataccaatgaaaagaaactgtggagactcatgcaccacatcgtttactgcatctcgaataagatatttatctaccatctgacgtaaaacagaataaccataagttagatttttattatgctttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagtcttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttgatagattcgtttaaaaccacaattaggtgaaacagggaaagtgaaaagcgttgtatttgaaaacactactcgcttatcgttattgcttcggatattcacattacactcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccatattgttcgcatgtttcttgaattggagtggcttgatgttcaaacggagaagcatgaaccttgcgcccagtcagcaaacgaccatagatatctaaagctttatctttagttgcatttaaacgacgatagctaacctgtgcacaacacgaagctgaaatagctttggcttcttccaaagtaagcacaacaacttctccagattcatcttgaacatagtatccaccaaaaacaaaatgatcgtcaccttctgtaccaatattatcatagaaatggtctacataaggtgtgtgccattgccctggtttcagcacttctggtgtagatccttcatactctttgtgcatctctttagccaaagcttcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcgaaacgtgctgcactaagcgcggcaagattccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacagtcggtgagtcatcaattctgaatgaataatacgtggatattctagttcaaaagttacaatctcttttccgtcttcagtgatggaatgcgcaataatactagccgaaatctgtcttgtcattttttctccttagtttttaaaattgtttaaagtgttaaaaacatccaaacatgttagccactgatcttctaaacctgtgatcacaacatttggttttttctttagttcttctaaatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaatgttcttaaaacatgtttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcgtagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttacggcgttttgctactgtgctttcaggttctattttacgcttcttcagccacgctttatctttcttagctctacacaaagctatcgcttctttttcagcttttgcttcttcaaaagatatgccttgcttgtctgcataagcaagaatagagttgcacaatttacaaaccattcgcaaatcttcttctttcacatagatcaaacggaaaacaaaaaggggaatatcctcaaaacattgaagttgttttgctgcgtgaatatgatccacttggaagtctttcattcctcctctgtgtccacatatttcgcactcacaattccaaacttgttttggttttccagttttcttgtctatcatcacattgccgtctttatctacacgatcaactttaaaacgccttgcattgataaccttaattttattagggtgtctcatccatgcttttctaaaacatcccctaagataagtataaaattcagcttgtgttttccagggtgttccttcaccccacattatttttggttcacctgccaatattgctcacctttttagctgtatattcccctggtgggatattatgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtattaaaggatcttttgtgaagaaatcaataagaagcatagcttgatcatgtttagctgcatttgtcatagatggataattttcacgaaccatatacgtgctattttgcataagggttctttctagttcaatacaatgaatagctttatctaggttaatctgacgttcacctttaatacgtgttgcgtattttgccaatttgcaaaaacaaggtgtgccaccaaccaaataagctagttcaataggttgcattaccatttttgtgtagtgatcaccgtcaacctgattatcaaaagcattagacataattttcctcctgaattcctactgcaccttcttctgggtagtctgcataataagctaccctaccttgatagataatatcaccatcgtcattataaattgctgtaccttcttggattgttatttcaacgtcaagtaaatctgggtctttctcgatggtatagttcaaacctaacatttcaaacagttcgaaaatttcgttacctgttaatgtaatgctcatatttcctccttttattgtggttagcagagtatacactaatataaaatttttgtcaataaaaaagggagcaataagctccctgattattagattccaatgatagttgctgctcgtttatccttggatctggtgtttgctctactacgtgacaaacctccacaagattcacaacgaatgatatcgaaagaacttaccgcagtgtggtattgtttaccagtaacaacgtgaacgtgatcactgccacaacgagaacaacggaccttctcatctgggtaataagcggataagttaggatgctgtggaatccacggaaggattttcatatacaaatcacggagcgaaacaacatcaccatcattgtaaatctgcatacgttcaaaagcatcacgatcaccttcacaacatgctttccataaagggaacccctcgttatccagtttttcactttctgtttcgaaatatgctcccatttctttaagggagttggaaggaagtgcaaattgtttcttagctgccttcaatgtatcaacaactacataattagaaggaggagccatatcgtgatatgcaaatcgttggttaatgtatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaggtcagcagaagagtaagataacaaataacccctacgaattacttgatctggagaaatgaaggctttgaatcgacggaaagtatatgcaatctctggtgcagtttcaacatcaataattttaataacgggttgtttctttttaactggctcttgtttacttgctccaaatcgtgcaaggaaatcgttcactgtgctttttcttgttggactacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagctgaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatatcgccaatagactcgtcaataagaattatatctggatttttaaatactccatcctctttgtagaaattaaaaaggatactaggagtatgtaaactatctttatctatagatactacgatataagaaaatttacccgtccttttataatctttatagccttggaaaccatacttctctaactcatcatcagcttctattacagtaacaacatcaccattgtggaactccacaagataatctttggtttctgaaagctgaaggggtttgatatctaatcgttcagatttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaatgatttcgaactcttcctttgtgaagggacgtttgtttttggaggctctttctgcatttgtatctcctagccaacctccaattttagtcttgcttttaccccaaaactctgtcttatttttaaattccttttgagcacctgaagggatgtgcttcgcaatgattgttcttttctctaatgcagatgctgcttggaaagcgatctgatcataatcaattgcagctattgtttcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtattgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggaccgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttcgacagctttagactcgtatagggattctttactccaaacaacaacgccctcgctatcctccattttgatataatttccgagagtaatacgatctgcttcgtgattctccagcaattcaccaaaacctttcacaatagcttcttcatgcacactaaaacctaccgaagggaaagtccccagaacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttccttcattgctttgactacttctttatcgacataaaactctttaccttcgctctccatgtcctgacgcatttcttctagacgttcattcaaaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacaaattccagaggaatatctgtaatgctgttaatggatgctacagaagcattgtcaccaacaaccataggcagagcggatttaaaagattttacaaacatgtttcctcctatttaatacatctcacattaccgcccgtaaagggcggcttacaacattacttgttaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctggatattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaagtcagataactggatactacaaaaatatccgctgctgcatccaagagttctacatgatcgtttactttcgcggctgtttcatactctttaagctcttcacgaacgaacccgatttgggacataaataactcttgagtgaattcaggttgttcaccacctcgtgctttggcattccaatcaattacgtgctttgctgcatttttgaaaaattcagtatcgaatttaatatctttaaaaaaattctcgatcattataactccttatttaaaatagctttctagaaagttgctaatatttactacagtctcacccatgtaaatccctgcgaaaccgaaaacaagcatacgtggaatattgaaataccatttatctgccggaaaagatgccagaattacaatagcaattgctatcaacatcataagaattgttgctaaaattatcataaaaatgcctccaggtattttgcacaatgataagctaagaacatttttcctccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattgatagtctcatgagcatctttacgcattaagaattcgactactttaccattttccatctcacctgtcaacactccatcgccatttttatcactttttgaatttattactttaacttcaagcgtatgacgaggcttacgtttaataacatcataagaacgtttatcaaattcgtaaactccgtgagtattacgatatactacaccttcagctttctcaagtaaagctttttcatagaaagcatcaaactgttcttggttttcaatatactctgtatgaaccacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactcccctttcatgttaatcatagaacgtaacccgttcagtttgtattgtgcataaccagggaacacaaccctttcaggataatctttataatcctggcatttcattggtgtagaaggaacatggttttcagcttcttcttttgttttataatagccattctttaactgttttgtccatttggcaaaagcttcaagttcagcttgttcttccggtgttgtttcattggaacgaccaatgtttttcgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccgacacgtccacaggtattgcaagtgattttatccccgtagaataaataatttttatcaccctctgtgtttacagttatgtcattactaccacaagggcaagtcagccaaccaacaacaacgatatcttttttcataatccctccttaagcattcagttcgttgttgagttcgtaaatctcttcttgaagagaatcgatctcttcctccaaacgggagatctcttcttttagatataccatttcagattctttctctcctaactcattttcaaattttactttattcgcctcattttcataatggagttcagcgtaatcatcgcgcatttgttcaataagatgaatcagagacaagatgtaattatctcccgtttcatcacgccactcttcaccgtggcggagaacggtaattcgtccagtatcttcatctaaaattgtctcatatttacgatcatctgtataaatctgcattatttctccttattgaagtttaagtgaaccacgaagacgcttctcttgctgatcacgaatatattgtggaacctcgtgaattgaatcattaccgtgcctattttcaacaactaaagagataacttgataaccaaactcttcagcaagagctagataaggtttaagttctttctctgtggttgaagtgttagaaacaataatcttgttaagattagatgccatagcatcacgaacaatactctgacaccatgcgtgtgctttacctacattttctggcttccaatcgtaaacaccactttctgtgtaatgatattgatctgcctcacagataggccaataaccttcagaaataatttctgctactgtagatttaccagcacctgaaacgccacgtaaaatgataagttgtttcatttatcctccaaagaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccgcgcataagaaacttcttagtaagatagtatggtgacttaatctttaagagtaagttaaacggatagtttgtttcacgaactacaaacccttcgtgtttacaatctttagacatttcaacaacatctgaaaacttaaccatcggatgaacttcaggacgcttaaatttggtgacagaagcaattccatcaagagcaccttcaggtaacataaaacttgtcccatcagggttttgaattctggcaccaattaagtatgcacctggttcttcttcgacaatatgcggatcagaaggatcacagatttcaaaaaggaaagttgcttttgcactttctgtccatttgatgaagtgttctatgtcatcacactctgaaacaatatgattctttgcaatacttgcaaaatctgattcaaggcttcctgttgtcgatacgataagttgacctttatatacacctacagaggccataaaaccatttactttacgaacaacatctacaaattcatccgctggtagatctgtgccattctcaaaacgattaaaaatcttagtgaaaggccaaataacaacattgtcatcagcgtcaacaacgattccgcgacattctagaagacgagaatcaatgttccataggttatcccagaaaactttgttcttatacttaagaacagatagaccagaatactctccttctttatatgttttcttatgaactaaacctttttcaactaaatcgtcgcaattaaatttagccacattactctcctttgattattttgtgatggtctacagttacgatatctcgtttactcatcatagaaattatctcatcaaaatgtaagatttttccgtgtgcatcccaacccacatctaacattttaccataagcttcatcagggaaagatccgtgggaatgcccgtgtagcatgattgatccacgaccttgcttattccaggaggccatagggtaatggcttaagacgaagaacagcttctgatatttcacttcgtcataatacaccacttctccatactctgcaagcacttctcggtgtttgctgtaatcatggttcccaacacaataagtgatatccccttggaggcgggaagcaatcttacgggtatcttcttcagttccgaaacagaagtcacccaaatgccacatcttgacacctggactcgtagcgcatttattccatgcttcgatcagtgcttctgtcatgtggtccatatcttcccacggtcgatattcaggagcaaactctcgtatacgtttgtgcataaaatgcaaatcacttgtaataaacattagtataatccctcgctaaatagttcatggtcgtgaccattacgctcatggtcgatctggtcagcattttccgcgatgatataagcatccgcacgactccaccaattgtaatactgatcgataaagccttgattatctggtgtgcacaaagttttgttgattacacctgcttctttcaacacgtttaactgtgcatatagtacaggatttgcatgtcgaacacaaggaataattaactcttcaccattattcaaaatatacttatttgcagcacagacgataacacgttgcgcataatgaccctcaccaatccaggtaagaggttggtaacaaatattgttttcaataccactcattgtttcctaaccctcctctcttaagttatcctcgaaaaaactagtatctggaagtaaaagatcattacttgtgtcgggccaatcctcttcttctcggtagataaagtaaccttcgtcctcttcttgttccgaccaaaccgaatgatgcatgttctctccttaatagtgcacacgaatcattttaataccataacgcagcatggattcttttgcaagcatgaatttatccccagcggcgggattagaagtatgcacgaaaatggtaggtgaaccaaagcaaggtttaccaaacgccagaagttcttccaggtacaggaaaacatcatacccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttacgcatatcatctatccaaactttcatataacctcctctaagctggcatgattaaaaaagaactctccacttcaaaatgccaatcctccacaagacctgattcccaatccttctcttcatggaaagagcaaatccaacggtacatacctggcggtgtattctcaacatcttctggcaacccgtaatccaaagctgtcaaaccgttctctgtaaaactaggatggagattaggagctttcaatacagaaaccctgcctccaacatctacagccacaatccactctgtcatgtatgggctgtcatattgaggctcatcagaacctacctcaacagcctctgtgcgtaagatgataagaggctgctctgtgattggggctttgacaatatacccgtgatcctcaaaaagatcgataacctcgaactcatcgccgttttcgacaccataactcttattcaaagagataaacttcgggttatcatcgtaagctttatttactttaattctcatttttcctccttcactttaacctcaaattctacaggcttaccctcaatgtaaaaacactgatactctgccttatcatcctcatcacgaggccaagttaccaaggagttatagcaatcttctggtgctttgaagatggttttagtctccacagtaacattcccattaagtgttgccaataccacccacccagctacagggatcatagtgcctccactttccacgttttacccttatcaaccaaggtctttgctacagcatactccttcccattaacaaggaaataataaacgataaaagatttcccgattgttactgtcttagtaacctctacacgtttaacaccttgcatgtattttgccttaccggaatagagtaaaatcattttgcattcctcttgttgttgataacatccatagcagtatatggtttattagtgccatgatactccagaatcattggagagccttcttgcactacttcaaagataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcatccctcttctttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcaatgtatcaatccactctaagaagtgttctttcgcttctgtgtagttctgtgtgcctttaacaacgtgtataccatctagtgttacacggaataccatttgaataacgtctttcatttcttacctcctttgttgtcaaagtagcttaccagaacatcgtgaaccacacacatagcaaaaatcagaacaattgttgccaggattgggttctcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccactccaaatactcaaagccatccaaatgattactcttgtccaacaggaatgctatctgcttccattcaatctgaatatcatttaaatgatatgctgcacagaagatatcctcatagtaaaagacgatcattgtcattgcttcgtcaagtacaactacctcttgtcttgtaaatctcattctagcctcctaaacgcgtctctgacgcactttttatatataagatgataaatcaccttacctagtaagtaaacttgctctacagcctcttatgaagcttatgttataggctatactattgctacctgtttaagcaaggtttttgcacacagaaaataatttttaataaaactcttgacttttgtgttcgaagtatgctaccctagaaatctattaacgagcgcagcgagttaaggttttaggttggtgatgtagtactctgtactcaagtactgtactccgtactagattaataattattaaatattaataataaataattattagatctaacaaacaggtacagtgtatcagaactggtacgtacagatcaacttctatcaattaaaaataaaataataaattattataaataatacttgatctatagattagtatgaagtacagtacgaaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagcttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagagatggatcttgaaattaatacttttaacgcagaagctttggttgttgctcttctggaaaagaaagatagtgaagaagtagcagaatatgcttaaataactattgacaaacgtatccttcatatgttaggatacgttcatcaagtgtggtaacagggtcgttgacttttgttaagaggggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacggggttggtggagtcaccattcatggtaaaatgttttaaaaaactattgacaactaacattattttatgttagattataagtatggaagggcaaatcgacgtggcgacgaaaacggtcttgaaaaccgccgagcttgaaagagccttgggagttcgactctccctccttccgccagattaggtagattggtgaaatggtagccacgacagtttgctaaactgtagtcggaaacggcgtgtaggttcgagtcctacatctaccgccaagttctttttaatatagcttactttagcagagtaaatcttcggcaagtggcggtaaccactttaccgataactcatagttagtggtgtgaacactggctattttaaaaagaatttaaatattagtatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcaaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagagtgggagcaccaacacaacattaagggcactgtgattgatcgtcgtatcctgtgcacaaggtctgttcgaaagacagtgttcttagtattgtgttgatcacacaaaaagagttacctgaaacttgaccggagtagggttggatggggcaaaagaagaagcggctctcccatcgacagcaacgaagaataatatttgactttggttttgtattattttaagttagcttaccgaacgtagggctagtcacccaacgggatactcgtcactgtcccactcaataaaactattgacaaccaatagtaaaatgtagtatagtaaagatgtagggcgttcttggtgtagcggtagcattccgtccttccaagtcggcggcacgagttcgatcctcgtagaacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacaaaggtgagtcactacctcaagtgtgaagttaaaaacgaggagccgccgaacactttcttttgcggtgtacctttagaatgttatgacggaatttagctcagtttggtagagtgtacgctttgggagcgtattgtcgcaggttcgaatcctgcaattccgaccaattaaatgtttcgtagttcaatggtagaacccacgactgataatcgtgagatacaagttcgattcttgtcgaaacaaccagtttcccgttagacttacaggataagagttccacaatttattgtgacgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaacttaacagtatttattagcctccttattggaggctttttgctatctattgaataaaacttgacttattattttttatatgttaagataaagtttaggaggattttattatgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaacccctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattatatatcattttgtgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataaacaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttctaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggaggcagattagtgaatattcgggagaggatatttaccaatacaatcctaagaataagcgtttagaattggtaacaccttattttgtagaatatgatttaaatggagataacctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccacacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacacaatatgaaatgctctatcttctgggacgtatgcgttcagagtcagaaacaagtttcatgttgtgcacatgtaaccctgacgcagatagttgggttttgaattgggtgttaccttatcttgatgagggtggttatcctagagaagatatgtgtggtaaacaaaaatatttcatcattgttaacgatgaacctgtttttgctgacacacctgaagaactgaaagaaaaatatccagaaaactgtttcatggaaaaccctaatacaggggagacagttgttattgaaccacaaactttcgtatttattggtgggacaatatttgataacccagaactcattaggcttaaccctaattacttagcacagcttaaatcacaaacagcgattaaaagagcacagcttctggacggttgttggtttgcacgtattcagaaagaatctttctttcaacgtgaatggttacataaaatatcttataaagatgttcctaacaatcttaaactaatgcgagcatgggataaagctgtttcagttcctacagaaacttaccgttatccagactatacaacatctgtcaaaatgggtaaagaccaagatggtaatatctacatctttggcgactatgattatgatgctgtggatgagaaaagtaaaattttcggaaggtttcgaagactacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcctcttgttttaatactctgtcaaaagagaatactttcaaggcagtagctatccctacaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaagaacgtacactaaaaagtcagaatactgggacaaaggtgctgcaaataaagctgctctctctccaacaaaagaagcagagaaagagaaaacgttactcctgtcacctgaaataggaacgatcggattaaactcaatcaaagcatttacgaatttcatgcaaccctatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatacgggtttgcattcgcagagaaagtttatgagttggatgaagatcctaaaagtccttactttgggtattggcgattgaccaaattggcttttagaccacaagacactcttcacatggctcaaccttttacatattcggcagacggacgttctattctatctgttaaccagaatatcaccaatacgatgttagctccaggtaatacaactttagaaacgggtattaaagaaattcctttcagtaaagttttatttgttggtagcaacattacagagaataacccattaggagttagtccgctgttagctgtatatcgtagctggcgtgaaaaatctcttattcaggaatttgaggttattggggtatctaaagatttaggcggtatgccagttcttaaggttccaagtgacattctaaacagggcatctttagatcctgcgggggatgaagcacaatctcttcgagttctccaagccaacatcgctaacctgcactctggtgagcaagcctacatggtgttgccttcagacgtttatgaaggcacagtgatgcgtcaatacgatcttgtattccaaggtgttgatggcacgggtaaacagtttgacactcaagcactaatcaaacaacgtaaactggatatttataaccgctttggtgcgggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcagttggtagcctctggtgcgatacctttaaccccagaagttattaacgagtttcttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctctagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaaccttcgctggttttaaagagaattctgaatcccaacaagattctataccatctcaaaaacctgaaactctagtcaaacaaaataaatttgatgaagaaaagatgcaggttattgaggtcttgtattgtccacctgaagaagacgatctccacggagagcgcatgtctgatttggaaatcaggaagatggttgacaacttcaatgagaatattaccaacattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttctggaaaagctacggaagagtcactaggtgctcatattgcttacacttttgattttcaaggtggagcggcatctggttataataccccccttttatttaagtcagacggatctccagacataacttttgaaaagttagaagctctcactaaaatgggagaagatgttacagagttacgtaaaagctatattcaacaagtgatggatcgcatttctgaaaaagtgcgtgaaaaatttgaagctggttgggattgggtttacgttattgatgctgacttcgatgcgaacgttgcaattttctgttcagataacggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagacaataaagatatcgctgaaactatcgtcaaagcattcgaaaaagcacgtgcagaagtggacgcagttaagaaagaatttggaacagaacgtggtgttgacgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgacgatgtagcagtaggtgacactttcaccgcagttgttggcgtacgtgatcttactctgaaccgctttgcagtatactacaaagatggctccctggtagatgacgctggcgtagcagcactggaaacacatgatctgaaactgaccgaaaaagtcgttttcacttcttaattttaataggagattaatataatgccagcagtaattttagatcaggttgtagatttcagccctatgatcgaacttcaggattcccctgatacactgattgccagcctgaatctgttcagtgttgactatcattcaactaccgctattgaaatcggtaaagaaaaagctgaagatgctctgatctccgctcgtgagcgtggtggtgagcgtaacttcctgaccatgaaaaatccagaactgaaagcgttccgcattccgttcttccctctggataaaaacatcaaagctcaagatattcaatctttccgtagctttgcaatggcaggaatcaatgactctctgcgcacagacgctgaagttgttaaccgctatatgtcccagattctgcgtgacgtagcaaaaaccaaagaaaaaatctttgcagaagcagttatgggtcgtgcctataacggcgtaggtggtgcagctaactctgcatacaactggtataccgaatggggtgctacccagaaatctgttgctgtagactttgcttctaccactgtttctccagcagccactatcgaacaagaagctcgtgcttacatcatcgatactaaacaagatggctctaccgctacccgtatcgtagctctgtgttctcgtgagtttttcgcatctctggttaactctccatttgttcgccaggcatatcagtatttccagggaactcctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcaccgcactattcagcttcagtctgaattctcgctgctcgcagttaacacccgtccagaactggtagttaaactgactacggcttaatagaactctgttaatattagaggctcgtccgtgatgggcgagccttttctgtttacaataagagtttacaatgaggagattgatatgtcaaacccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacgcgtttgagagaagaaacaggtattcttgtgcatccttttgcaagtgaagaacacatgggttactatcttgtaagttacgaagactattcgcctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcgatgctgattcagatcatccaaacttggattgatattatagggaatgaagataaggataagtgtgcagtattgtggaacagcttgatttctgttttagagtatttatggaacaacgatgttcttaacaacagtactcaaacaggaggagctatgtcccgcagagaaaagatgggtgaagtcgaagttgaagttaaatttaacaacggtcaagtcacttataaatctccgtgggaagatatctatcataactatttaaatggtcttatggtgatccctgggtgcacggcaggacgaggagcaaccagcaaagttcttattggcggtgtggatgctcgtgagattgatcgagtaaacagcgatcctaactctgtaaatggtcttggtaatgttgcaagtgttgatcgtaatacacgcaacgttaattatttgcgaaattacggacctgtttctttttatcgtagggacaaataatggaaagtgagatcttaccaggtgacgatacagattgggaaaccattatcaaaaagatgatggaccttgaacaagttcaaatcgaggctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttactgaataatgtcgggttagctgtttttgagcctatagcgagagcctctaaagaaggaatagctcaagcgattgcaatgcaacgttatcgtcctttatctcctgtgacaattaagatacgacaagataaaggcaactattctaatcatatcttaatagatacggcacacatgataaatgcaatcgaaacaaaaatcacaaaaagcaagtctaaaaaataacttgcataaactttgtttttgatgtatactaaaaaggagatacaagtgttactagatcaatttactctccttgatctaactgaataccaaggtcgtagacgagtctacaaagaggcagttggttcagttattgctaacttagaaagtagtgtagaatatgaaccatttaccattgaagcggcaagcttacaaccgatatctggtaaaacactgaatgcactacctgaaggttacagatctaaggctcaatatagtttctggactaaaacagaaatgaaggggttacaacaaggaacagaacagttatcagatcaaatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacaattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattttaaacagggtttatgcaattactttggttccaggcgaatactcgtcagtcaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcccctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagttatggttggtaagcgtgaagttacaaactttactctaactccaatcgtagaagatagtgcaacttacacaattaccatcaaaaatggtaccaagaaaaaagaatttaaattcattgctgatgatactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatattgctgctctgcatgatattgatagtagctggttctggaccctttcagattcccatgaaacagaagatgttctagctttggctgcatgggtagaagagaatgataaagtttacttcttctctagttctgaacctggaattaaaacgaaagcagaagataacgttctggaacgactgaatgacctcggttataataacacttgctttgctttgtggatgaccgatgcagattctgtattcccagaagcagcagttgttggtgcaatctgttctcgtcaacctggtttaactactcttcacggtaaaacactggtaggtgtagagatcgagaaactggatcagacttcggaaaacaatattgttcaacagaacggtaacatctatcgtaaagagcatggaactctgttctatcgtgacggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgactgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggcgacgtttcactggctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttagatggaaacagatctgttactttccgtattatgaagtggagtccatctaaagtgtttgacaggattccagaattgggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttacggctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattggataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccaaaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagtcaaaaacctatgcgagcacctactcccgctggagcgggtgctcctgtaggcggatctggtagacctagaactcctaaaaccccgcaaggaagagaagaagaaaaagctcgtaaagctgctgaacgcgaagctaaagcagcagcacgtagggaagatttaggtaatcttcgtttgcagaactttaactacagagcaagagcatttagtaaagccagtcctggcgctatgcaagaagctagagacgttatgggtaaagctgtagagcaatacaaaaagggtgaaataactcttcaacgtatgaaccaagctcttgctcaccagttagatgccttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtcgatatggacaattaaaagaaggtgcagcaggtcttaatccacgcatgattgcatcctctttaataggtgctgggctgtttgcaggtggttctgtagttggtaacacgttgatgaatactaacgaaagaattaaacttgtaagtcgtggtgctgaaaacgttcagacaaacgccaacgctattttggcaatgacagcttggggtgaacagaacggtgtagactctgcaaatattattaagtcaatagataatattaaagacgttcgtgaacgtcttggtaatacagttttagcctcaaaatggaatgagaaagaagggaagtggaaaggcggtgataatggcataaatgacattatgaacttgtttggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataatgttaaagtgctagatcagtttgccaaagatttaggtgaagaactcggtaagacaacagttcaattaggaggttttgctaaagaattgggagatggtttcggatcttttaccaattggcttaaagaaacattcccagatacattcggagataacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttagctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataattaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctcaaaggctactcttatgattataaatctgaatttgctatgcaatttgatttagagtttaaacaaatccgtctcgtttctaaggccactactaatgctattgctgtaaaaacagcaccaaataaatcgactggtggtgatgtgaaaggtcaagttgcttcgaatggtcctaagtcagatattacagtaagaactgctgaagctactaataccccaacaaacaacggaggttaatagtgacaacttattctaaaacaacaaggtctacaagtaatacaggctacagtgcagtttatctagaggaccattctacttattttgcatggtatctgaaaactgaagagtatcctgatcaaacatatacagttacattggatggagttgattatgacattcgtttaaggtggaacactagggacgagtcttggcaatgtcagattggattatctggagatgatccaagtataagtttcaaagttacaaatggtttagatcttcttaaaccttataaatatcttgaaagtgtgccagatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctaccgtagatttggataccaagttaggaacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacattgtttagatggcggtattaacattgcagaagcaagaacaagccgcagttatccaaaaggaactaaaatcaaacgtgttgtgacagatttggtaaaggatttaggaactacagaaggtaatatacacgtagataatgatcaaaccttatcctcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctacattagccctgaaactggtctgataggaagtccagaaccattccacaacgatataaaacctactaaaaaagttaccaagtcatctaagaaggcaaagaaacctacagatggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattaaattttgtcacagcaatgcgtggcttaatgacagaacaattagcagaagtccatacagccctgccagtccgtgtgactggcgttaattatggtgctaaaactgtcactttagaatctattgttaaaaacacacgatctagtgaagatgaaatagattaccctacttttgaagatgttccttttatggttaatgggggtgggacaggaagaatctcattccctattaaagctggcgatttaggaactgttatattttctgaaagagatccttctaatgcactgcaaactagtggagaaacctcttcatcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtggcagatatcaatggtcttaaaatagatcagaacggtttgatgacagatggtaatggcatcggattccatactcacacgcacacggttcgtaacattcagagcggtagctcaagtgccgagtccttaaaaccaacaggagcctaacatgggaatcccttttgacttaaagcttggaccaaacaacgacctcatcatggatgatggggatttggtcctcactacaaccagaacagaaattgcagcacaaactcttgggataactctgaacacgtatcgtggggagtggtttttaaatactaacttcggtgttccttacttacaagagattattggtgttgccagaaagaaagatattgtagacagaatatttttagcagagattgccaaaaacgtttacatagatacaataaacagttataaatctgcttatgatatggatcaacgttattactcaatgacagttatggtcacagttggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgctgttgagtggtgcaggggtaactagaaaccgtttaaatgcacgtggaacagtaactagcaccttggcattagatattagttcggcagaatatttttcagcaactttatcttctgcaacgtgcacaattagttttactaatattccagtagcaacaaatgcagttttaaactttactttagctttgcgtcaaggaagtggtgcaaataaagtcgtatggccttcttctgtaaaatggagttttggtcgttccccagttttgagttatcgtcaaggtgcaacagacacttttgagtttatcagttatgataatggagcaacttggacaggtagcttagttttagcaggagttatttaatgtcaagagttaagcacaatattgacaacacgtttcagttgattgaagggttggttcagtttttggaaagaaatactgggcttaccatagatcctacggttcagcattacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatcttgaatctgccgagaagtattggcaagcctacatagatcacttcttcgggggccaacctattcctgatcctccggctaaatatcgtcccaactggatcatcaatggtaaagaaccacgtttagcacattaccctctcacagatgatgggtatcctacgcacggtgggttcaaaggtagcatgatgacttggattaacggaaggactgttattcctaaaggtgcgccacactggggagaatacttagataaagcttggtttgctttcaatggtaatcttggttggaactctgttaacgcaacagtgtatgcaactaacccagacggttcaaccaactggaaagaatatggagatcagtgggacgttgaatggattatagaccgtctaggacgtaaagttgattgggatggtaacattttatctattggtcatagctttgcagaatatggaacagtacaacttaaaaatgcttctgtgaacggggactataaattcaactacgctacatgcaatcctgtagaacacggtggatatctgcttaagcgtaatgagatgtggcataaccgtcctgtaaacgttccggtagagttaggctatcaagataatgcttccgatgctgaaacgtggtggtgtgatgcaaactacttgatgtatcagatcacaggagagagaaaatactggctttgctggcaatcttctttattgttgtgtcaagactactcaaacatcgatatgtttgataaattcttccgtagatctacgacagcaataattccttttacagatggtatctcgtatgattactcatacccatctacagcaatacctaaatattctcgtgacgaattaggatacacagtaattcgccaagatgtttcagcacaaacaactctagaacaacaggcagtttggttcagagtggatcagaattcaaaacttcgtattgagtttcaaggtgtagatgatgcaggggaaggtgttcttttccgtccagagttagaattaagcaaaactaagagtgaaacagatacagttacatatcgttgtggcttacctcttggtgcagctaatatgactaagatggatatacctttatccagttttatgcgcactgaacctcctggaggcggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacatatcgttcatacgcagatgattttaacatcactattacggattccgcaggttggagatggtgggccatgttagaaaaaacaaattctacatgggttactaaagctttaagtcctgctgatttcaaattaagcacttggcaacccaatcataacgacacagagacaaaaccttcgtcaataaacctgactgctgttgatcagatcaacattgcattggattctgaacctgcaaatggcttgacaggggcaatcgatttttattgtgttaacgatatcccatctttgtattcttcagccgctggtgatgattacacaatgtatttcagggttacagtttcatctgaaaatccttatacagcaaaacttggagattgtacaatactggactacaaacttgacagtttgaattatactccaggaatcattccattttccaatattagtgatcctaacacagcattatatgacggttggcgtggtattccttacccaggttatcaatacccatccttatattgttttaaagggagagatattgactgggttcgtatgaacaacagtatagactttttatatgattcacaaatgtggttttataataagtttgcccctgtaatgcctgggccaatggcacaagcttatgtttgggatcgttgggatgctcataaatatggaaacaaaaatgagttcacaatgtatcattggaacgataaagcttgggatggttatgaagcacgagcattcttctgtgcgtgtcatacggtatacgaactaaagcgacaaggagccgaagttcctgaaaaacttttaacagtttgtaaaaactggatcaactacctgaagtggttccaagataacaacgaaggaagaacaccaacaatattttatcccaacggagaagtggctgcgcctgtagatgactttacaagtcacatgtctgcgctctttatggcgggatgtgctataatggggatggctggatatgattcagaaatccctaacattaaaatagtagcagaccgctgttttgaacttattcaggaaaactatattgttcttggtcctaatcacgttatgaatggttgttggagtgctgctcctagaccagacagtgataacggagtcttctttggcttccacgctggagagttgttacgtggttttgggttgtatgctttatacaaaaaacttaatccccaaaatgcattacctgttttggattcgagcaatattcctgcacttactgttttgacaatggcaaacattagtgtggacgttaccgagtaaggggtaaaatgaaacaagctatatttactgtcacgcgagacaagagagtaaatgcgagttcatttaactacacgactgttgacggaacagcagtcgctggtagagattatattgcaaaatcgggaacacttgtgttccctgatgatgctgattctgctactattgtggttgaagtatttgaacgaccaaagaactcaatagatcttaacttctccctccaagtttcagggattagtcaaaataacatgatggttgaaacaaccatcaattgtattataactactatccaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagtacagttgacaaatatgaccataaaggtgttgggtatttgcctcacacagatttaagttcagagaaactttggtttaaaatggaaattagtcaaaacatgccaggttttaaagaagaacctttggtgccgactttgactgtaactctcctggataaaagtgttcattatgtcagtttaggattctacgcttcagatatttcagaagatggtaaaacagcaacaataaagttagattttggtaatatcttttctggccctaataatgatattcctttggatatgagtgctgtagataatattttcttctctttgattacagcaaggtatgaagaaatagaagaggttgtacctattggcagtcaagaggcttggtttactttcactcttcttgaacctacctctggttatagtatgatgaaagtcagcaaccttgtccagcctgaacatgatattcgcatgtgcacatcttatgatgatatgtataacctgactccagagagagttatttataatacatatgcactaggttatcgtggaatgattaaccattacaacggaatgtctcactattatgagttctcatggaacggaacatcttgggctttaaatagatctgtcttcctgaatccagctacagaagcttggctaaatagtttccattctatagcgaacgagaagggttacacaataatgaactctttaagttttgagttgatgagcacagtttgtcctgttgaatgggtccagcatgattggaacgatgctcttgcagcaacagggtataagcctcctagttacgtgttgtctccaactattgacgaaggcatggaatatttgcaaaatgttattaacaaaatagcatctatttctcaagctaacaatattccagtcgtcattcaaattggtgaaccttggtggtggtataatacagcaagtaaaatgccttgcatatacgattacactaccaaactggcattcaacacagaaactggcttatttgcacaagatgcaggaacaatagataattataaaacaggaacgccgtttgacgaatattatgcgtttttgtctcgtaaactaggattaagagttacaaagtttgcaacagatactagagcatcttacccaggagctaaagtaacattgcttccgttcttaccatcgattatcggcaacggtttgatggagaaagttaactttccgtctgattactacattcctgaagcttttgatttttactgttcagagtgttacgactggcttctggaaggtaagatgatgaaagcatttgatgcaattaccataccacatgaaaaattaggttttgaatattctgatattcactatctttcaggttttgttccagatgctactcttgcgcctttgtatggcttcgatcctgaatcaaactaccgcacgtatctttggaaaatgattataggtaatatagtgttgaacgccaacaagtttaacggacttacacaatatatatgggcctatcctcaaataatgcacgattccattacggtagttaactctcaatcccaagttttctatatgggtaatgtgcctttgaattgttatttgcaagatatcaatcttaaacaagcaaatgttgagattgctaccataagtggaattacattagctactaaatctggagaagatttagtaacaacacaaaaattttatatataggagtaaaaatgtcaactacaattactaatttacccgaaacatcaaaagttaatgattctgattacctggttttagaccaacctgataagactgttaaaagcacagtttccaactttcttactgacactggggtggttttagccacccagttgaaagatacagatggtgctaccaagtatccagaacttcaaatgtcacgttggagagatgaaggtgatcctagaggatggggagcagtaggtgacggagcaacagacgatactaatgccataacacagcttcttgctgctatgcctgatggatggattgttgatgggcgtaatctcactttcaaggttacaacactaccagatataagcaagtttaaaaacgccgcttttgtttacgagcgtattgttggacaaccccttacttacgtatctgcgggtttcttcgatggaaatctgacaaaaattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgtatgagtatgggtgtatgtggtaatcgcttatatgcagtgatcgaaacccgttacttatctaacatgcgattgaagaaagcagaactttggtcacgtccaatgccttattatagaaggccaactggaggcataacaattagttctgggtctactacagcgacaattgttttagaaaagcatggtcttaaagttggagatgctgttaacttttccaattcaggtgcaactggcgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagatttatgtgttacagaaacccatagttttacagttatagatgatgataattacacttttgctgttggttatcacaatggtgatgtttccccaagaagattaggtattttgtatttcaataatgcttactctgacccaagttcttttactcgtagaacaattagtcaagaatatgctgacaatgcagcagaaccctgcattaaatattatgatggaattttatatttaactactaggggtacttcaacttctgctgctggttctacattagcaatgagtaccgaccttggagaaaactggaattacttaagattccctaacaacgttcatcatacaaacttaccatttgcaaaagttggtaactacctttatatctttggtacagaacgttcattcggagaatgggaaggagaagaactagataatagatataaaggcacgtatcctcgaacgtttatgtgcaagattaatgtatcttcatggcctacatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggagataatagtaaaaaattatggtacaagcatgatggtcatccagccgatttatatagttatagactaaagattaccgaacatgattttgtatcacgtgatttcaaatatggagctacgccaaaccgtacgttgcctgtatctatgggtacagatggggtaaggcatgtctcagcccctgtaacttttgataatgatgtacaagtatactctttaacagttactggccttgagcatgatgggacgcaacaatctgccgttagaataaaattagacggtgattatggggttgttgcaaaaaatgtcccaataaaaaatccttctgaacagcgactaatcctatgtggaggagaaactccttacgttacggatggatcgctattacaactatatggttcaaaccatacgtatccaaacagagcagttttatatgccccaggaggagcatatacccaaaataatttcatgccgtatttagatggacaagttgcattaggcggtgcgtctaacagatggtcagaagtgtacgcatctacaggaaccattaatacttcggatggaacattaaaaactaaacctacagagattgaagatattttactgaaagcatgggaagatattcatgtaatctcttaccaatggcttagtgctgtcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacgggacaaaaagaaatccctttatttgatgatgaagggaatgttgtaattgatgaagaaggtaatccagtaacaatcgtagaagatgttgtagaaactatcgaaataattccagcaggatcgcgatggggtatccgcgctgaccaaatgttttttattgagatggcttatcaacgtaaaaagttaaaagctcttgaagaaagacttgcaaccctggaaagtaaataatacagcttaggtggtatttcaatctttatatctcacttagaggtactcatggctaaagagaaaaacggttttaaaaaatttattcgcggaatgttctgcacttaccccggcaacggggtaagctctacgaaagtctggaacgctgtaggcatgtctgttatgacaggcatgtttatctttttaggaatagaaaaagaaattcctgaatggatgggttgggcttttgttttcatgataaccccttctcgcctcatgaaaaatcttattgatttacgttggggcagatcacaatctactaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcgggcaactgtttagaataattgcatacacagattacacattgtgggaaggtatgcaaggtgtttataatactcaaacactggatggtgcagaaggtatttatcttgacgaaatcttttctaaacgcggtttctatcgagcaggggcagcagcaagtacaggttatgcatatgttaagagcaataacaaagcagcttggacttatgagctaggcacggatatttacttcaactctgacagtgatatgaactactatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataacagatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacagggatatcttctacctttacaggttatcttgacagtggtaacttctattcattttctcctggtcgggatgttgagacagacgcagaattccgctctcgtttcaatgacaacgttgatgaagctaacgcagggacacgagcagctattgtgaaagctctgctacttacagatggtgttactaaggtgaagatttatgataaccctacattacatgatcaagaacatgctccagctatgactttccagactatagtttatggtggcagtgcagaagaaattgcaaatgttatctataaaaccaaaccaatcaacactttgacacacggaacaactaacataacagttacaacagaagacggaggacaagaaattattcgcttctctcctggtgcttctgctatgtattccgtaaaacttgtttatcaaactgtcaacggaacaactttaagtggaacagaaaaacaaaacatcgtagaagctctacaaaacctgcaagcttactttgagttaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagatgttaaaaaccttctgattgaagattttaaatcttctcctaacattgtcaagctcctctacatcgtatccagtgaaaagcaaaagatagatcaggcaatgatctatcttgctaaacaccgcttgatctccacagccacaggcaaatacctagatatcttaggagaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaatcagacctaaagaaaccatccgcacagttggtatggattatggtcaaatcatgacttgcgaagaaatgaactggattcttaataatatcggtttatggattcgctatttggtggatgactttcttccaactttacctgatacttacttgcctttagttggaactaagattacaatggcaggtgatgctactggtgaggctacttggaatggtaataaagaagttactttatctatccaagttcaagataacagtcataatcacttgtcggcaaacattacagatgctactagttcaacagtaacaccaaacgtgttggtaaaacgtgatgcgggtggtgctatttatggtggtgatgtttatgttaacggtacttccacaacagatcctgcgacactgtttttcaaaaactttgcaggacaaactaatggtgagatttctgccgaataccaaagtggaggtcagctttatatttatcgtagaaatcctagcacaggtagtgtatcagcaggtgttcgtttatatgatgcaggttatgttctaatagacagtccaagatcaaacagtggacaagatacttctaacggaaatgctttagttcgcttagattatctgaattctcgtttgacttctcttcagaacacattgcagacgaatattaacactgttcaaaacaacctgaatagtgttaacagcaacctctcttcccgtataaacaatgtagaaagtaatcatcaaagtcagattacaaacaactacaactatgctaacggaacctttgtaagagatattcgttacactagccaaggcgtgtattatccaccagggaacgaagtttcttggacttatatctgttcttctggttatgttctttctggtattattgtccaggaaacagggcgtagttctgcggataacatcggtggggtttatttcaaacgcctccagcgcaacgttaacggaaactggtacgatatcggaggctaaatgatatttacaaattttaaaagatatattcccgaagatcccgaactaaaagaattggtagaagtagagaacattctttttcttcgttgcgatcaaggttacgattggtatgatttacgtagcacagaattcaataacgataaaatgaaagtcgtttttgacgatcaaaatcgtattgtgttttggaacactgatcctacattactttgccctgaagatctttctatagcacaagtggactttaatatagacacttttgaggatattagaaacaaggttctggatttagaaactttgactcttaaggataaagagtattcccgcgaagagttgatgacacaagctagtgcaaaaattcgctctttacaagaaacagcggtagcacttataacacctttacagtatgctaaagatttagaaatggctactgaagatgaattagcttatcttaaaaatcttcaagtttatgtggttaaactaaaccgtgttccgcttcaaaaagactatccttacactatagattggcctacattaccaacggaataagggatcattatggaatttcaagaagcatggggacttgcaaaggatgcaataatccctttaatcggagtcatctggttctttttcaaacaaaaaatggataaattcggctctgatcttgatgaaatggaggagaaaagtcgagagctagagaagaagttggtctttgttgaatcaacttatgcaactaaagccgaacttacccagatgctaaatcaaattaactctacattaatggcaaataataacactcttgagcaaaaaattgaaaagattatggacctcaagaatgcgactatccaaatgatgctagatgacatagttaaacgtacacagaataaggggtaattaatggcaacattcccaacgtatccagcaacgtctcttgaacagggcgtagatctggttattttctcgtccaatcaacttcatgatgttattaatggaagtgcgacagaaagtattgagacagaatcagggttgataccaaccctgagaaaagcccttgttgataactttttctttaaaagcccattggattgggcgcaaggcacaaatgaaacggtttttaaccaactacgttattttcagaatggggtattgagcggttattattatgctcctaatgctacattggtaaacccaatccctatgcaaggtactccagtaggagataacaactgggtattgtggggattgaagacagaacaattggcaacagaagtcacaccttgggtatattctggtgcaactggttatgaaacagtaatcagtcctccttacatctttgatagtgctattgttacgatcaatggtgttattcaggttctgggggaagctttccgtatagaagatagtaagatcatcttatctgaacctttgggacacgatcctgcaacaggactgccaaacaagcttttcgcttatattggtaaaatcgtagcttcagcagatacagatcctaatctagagaaccgtcttgttagtttagaaacaaaaacggaagaactaacagaaagcatggataaagtccctctgcaaactattgctcgtaaatatggtttgttagatgatgaggtggcttacgcaacagcaggtcaatcgttaacagggattaaagctctgtatgatccggtagcacagtcttcctacacattacctcctaacatcacaggaactttaacatctttgtctgtttctggagtaatgacttattctggagggtctgtagatctttctgcactagctgttgaacgtggacagtttgtccatttgcctacaagctttggtaataatgtaactctgacagctaaaaatcagacgattggacgtggtgctggtcgttatcgttgggctggaagtttaccaaaaagtattttggcctctgacacattagagacaagcggtggattaggtccaaacgcatgggttctaactaatacggaaggactgttaacccctcgtggtggaacatacaacgatttattcgatgttgtctacttgtcagaatttgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgcggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggggaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatctctatcgaaaacattcatggcgatccagaccagaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggacgaagagggtaatccggtagttccggcacagggtagaccttcaaacccatgctttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccagggacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaacgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatcccattgtaacgcctacaagtgctggagttagaattaaaaccatacctaatgattccagtaatgtttctgtaggtaatactgcggttattcgcccaacgccagtagtagatgtgccaacaacctaatggaatagagggggaatccccctcttcttccaatagaatggtctaatgataggagagataaatgaatttaacaagacctaatagtgcgatagccgatctggtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcaatgcagcaacaaattgatgatctgtcggaaacaatacctgaagctggtaaatcggcttatcagatcgcacttgataatggttttgttggaacagaagcacaatggcttgcctctttgaaaggggatactggtgctcaacttaatattaaaggatcgttagcaagcactagtgaactaccatccacaggtaacgttgcaggggatggttatatcgtaggtgatgtaatctacgcttgggatggttctgtttggaaacttatttcttctcttgggccagaaggtaaatcagcttacgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaacgggacagcttgggtcaacatgggtaatattgttggtcctcaaggtccacaaggtgaggcaggtaaagacggtcttgatggaacagatggagatgaagggaaatctgcatatcaaagttggctggatgctggtaatgaagggacagaagtagattttattgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggcgatgcatataaaattaataatgatttgtatgtttgggttcaagatgctacggaatggatgaatgttggcagtcttggaggaatatcaattacagctaaaggtcatgttccgaacagtgaagctctccctgtttacaataactatggtgatgcttacttaactgaagacactagtaatctttacatctatacttacgatcaagacaccaattccgcatcttttgttgacatgggaagtattaaaggtgacaaaggtgaaaaaggggctaaaggagataagggtgatcctggaacaaacggaaccaacggtactgatggggccaacggtaaggacggcgcacagtggtttgtagcaacaactaatccagtcgcaggagacggtgttatcaatgattacgccttcaatactaacactggagcagtgtttaagaaaacagattcttctacgtggacacttataggaactcttcctagtataccagaagcccctcaagatggtttgacgtatggtcgttctgatggaaactggatcgaaatatcaggatcagatcctacagaagctataacaccgactagagttacagcaggtttcatggaacttgaaacaactactgccaactctggagcatcttggactccttctggaacttccaatatgtatgttgttacagtaactgacgctctgacagttggagcatggcctggtgtcactggctctacaaaacctaaagcgttttcagcaatgatttatttgattcaagatacaacgggacacacggttacactagatgcgtcttatggagcactaaatgatacagaaatagcaactactgctaacgcagtaacaattttgcaattaacgtatcctggtgtgggtgatatcgtggacatggttgttgtaacacgataacagaagccccgaaaggggctttctttttatggagggtttaaatgtttccaattccaatatttactattatgaccagcactggtgtcgttcctctgccagcaggtattgttaaaaaagtaatcactttagattacccagataatgctggtaattctaacagcagtttagcaattttgcttaatgatggtagattgtttactcaaggcgcaaacctttttggtgagattgcagatggaactcgtagtgcacgattcaataatttccacttagcttctactgtagtagcggatgtgtttaccgcagatcgttgttttgttattaaaactaacagtgggggatggcaatattcaggattgacagcaggattggtaggatctatagcagcaggtggtacggacgcatgtgtaactacttggaccagctttccatctgtaataacagggactatctctttagccaatcttaaagaggttaagggaggatataacaacactctctggttaatgaatagtggtgttctttatggatcaggtcaaaacacagtaggcagtttaggtgcaagtactactaacgaagtttctactcctcgtcagataacaagtgcagcagttgcttttgatgcaggttacaaccaatgctcttatgtcaacaatgtgggaaccttgcgtgtttgtggagctagtaaaggtttagcaggtaataataacacaacaacagcttttgtcaatgctaagatatccgctactgaaacagtgtatgtcaaagattacatcaatacagtttcccagacaatagttgtaggagatacctccggtggcacgggtacagtaaactacttatatgttagatctaatacagaaacaacctacactaaactggatacctttgcagcaggtttctcaacatggaagtttccaccaagccgccactcttttttcgttgggatcaataattccttgtgggctattggtaagaactacactgcaaacttaggtttggggtatgattctgcgagcggagatccactccaagtgggaaaaccagttaaacctgaaggagtgggttcttgggatataaacaagctcacaagcgttcatacgctgaatatggatgttactaaccaattaggttatcaaggaacttttttcgtttataatggggatatgtattattccggtatttggaaagatgggaaagcctcgtatctgttcaatagtggtctaaactataataaattcacaccaatagcaagctccgtgattacgggtgatattctggcaactggcttaactacagattctttaggaatttgtattgtaggtggaactaaacagttgacacattctgttagcccagaaggaggtaaacttttcaatattaaatacacttcttctgcccctgcaaacatgacaatatcatctactggtttaatgactttccatgcagaaggtggttttgatgcaggtatgacagccttaaacgctgaaggaacaaccttatcagatacctctggaggatatgcttcaacattgagcgtttacactcctagcttatctgcgatggatgtaggaacaacacaaacaatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacatatcaaggtgttgttaccgcttctgatagttcttatttaacggtgaatgctgttgcgggaaaggagttagctccatctccgagtagtagcttaacggttctaaacggatatttcaaccactcggcagatggggcaattacgttcccaattttatcgggtactgtcacaccagctaactttgtagttaaggtggatgacgttgtaataccttcaaataaagtaatatttagaaataaagctttctctacagtggatagttatccagcaggagaatatagactggctattgaatttgcaagtgcttcagtagtgaatagtgttgatgtgtctatggaagcaaatccaaatcttttagaattatggggcggcaacagaattggttattctacaagcccagcctcacaattcttaaaaggttgtgctaacttaagacgaataacttctgattgttttagtaacacatcttacaccggaacatctataagtggtatcttctctggctgtacaagtttgacagctatccctgaaggattattcagtgatgctttatttccttcactgacaacaatgtcaagcacgtttgaaggttgtacatctttaacatctattccttcagatttatttaagaatctatcaaaagttacaagatattcttacacctttaaagattgcacctctcttgcagaagttccagcaggaatgtttgataatattccaacgaaagtgacctctttaacagctacattccaaggttgtttagcacttacggattttaataaaatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccaattataaataagaaaaggagccatttggctcctttcttttataaaaactctttataaatcaataagatcagaacggaatatcatcatcgaagtccattggaggttcttcttgattacttggagttggttctggttgtggttcaggtttcttaacttctttcttctcttctttcttaggctgttctgcggaaccacgaatggcagcagcaactttatcagacagagccagaactttacgagcagaatcaatcagatcttctacagatacagtcttaatagtatggtctttacaagcattgaggatagcgtgaccaacagatgccccaagatcataatcattaatatcaacgccacgagattcagcaatttccgatttcagcgtgacagttgcagattgaacaaccccagcgatatcgaaagcatcgcctttaacaccattacgaatcagttccagtgcaccatttactgcgtgaccagtttccagacctacagtatcacgttttttataggattgcttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcgccttctttgacttgcaggttttcataaccttctttcagttcaatgtcaccaagagaaatccaaacacctttctcatctggtttagcacctttctctttcagaacaagagaagctcggtgagttgaaacaatcgtttttccttcccaatggaaggttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgtcaaactggtatagtttccataaacagtttcaacagctatcttagaacgttcaatcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattgtcagaagcctctttgttccctagtttacgaatattggttcccattaaagcagatgcaattaatccttgtatttgttcttcagtccgatgtgcaggaagggatgtatagaaatccagatcacgtccagcaatatcaagaatacgccaatcacgaacagcaccgccagccaagacagaattaggatcagcgatctttaatatggtaagaatttctttggcaatattgatttgttttgatttagtcattgatacgctccacagttacttttacaacatcgtccatattaatctcatcccctaagacctcaataacaccttcctcataaagtcgagcacattcttcccacacttcagcttccgtcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataagacatatctttaccacaagaccaacaacggatatccccatcgtcccattcacgttcttcttcaccttcgaattcatctggtaggtaaggcataccaagacaatctaaatcgtaatgcatatctcctcctataaaggggcagaagccccttataaaacaatatgttagatcagtgacaggacgcccaagaattacccacatcatatccggcagtaagctgaacattaagattgtaaaattctccagccttagtaacagctaaggcagcaagttcacctgcccgactataggctgtaaaccatccacctttaggagattcatgaatgttagcccaaatttgccctgtctctttttccttattatgcttccattcttcgactttagcaaggcattctttatcaattttcttttgttcttcaggatcgtctactttcttccaacctaatgattcaggtgaaaaccatttaaattctacaaggttacgagaaacttcaagctgggcttcatcgtgatatgcaatcatttgttgcacgaaatctttattcttccagtcatctttaaagaagtcaacacttagtccttcttcttcgatcatgtcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccgatagtttcagtgatacgttttgccatcattgtgtgaacatcattaggtttctctaataacagagcgttacaatattcgtgtggctccggctcgtaccgccaacagtagtgtgattcaatttttgcttccaaagagtcgaagtcgtagccgatctggaagtatttaggaacctctacaccaaacaagttacgcatctcccatccaaacaaagatgtgacacgaggaatattagctacagatctatgcttcatacgagaggttgcagcatcacatgtagcggctggggtaggaatacgcccatccgcccttactgcggctaagaaacctttatcgtattcttgatcttcttcatcttcttcccaatcagcaccgccacctaaaatagagttcctacgatgcttatacgttaagtattctacaatctgtgtagcataaggaaacttctcacccaaagcttgcaggttaggacaaatttctttttcctgacctttggtaaaacatgggttagtcaatactttaagaccgcgacctttaccttttgctatacgctcttgaatcttcctttccagggtttccggtgtgcactccagatgatcacaacgatcctgacaaaaattagaagatagagtttgctcaacgtaagctcgaatacctttctgaagttcttcctcgctctttttaatcttggtgccagatttaagagtcaagtctttatctttatattcagacggtacccaacctaatcctacaagccagtttttaatatgggttgtatcgttcaatgttgcagggatgttaggatcacacagaggctcatctgctgcaactggcagtttccactctttccccaacataactaaccaccaatcgccatccctctcttccaaatgaccatcatgtttcttagcaaaattgatcatatggttagttggctctaagttctttttaatttgcaacttaggtggaataaaagctttaagataaccttttgttgctggtttaggtggcaaaataggctcaacgagtaaacgaagacgctccatttctgcatccaaaaaagcaaggttctcttctgcttgtttcatgttaaaagcaaacccacggtgttcctggcgtgtaataatgtctgctacacgttgttcaagttcaaatggaccttcccatttatcataatcaccccattcttccataaggtaattatatacgctcgtattggctttgttgtcatagatacagtaataaagcatatccgcagcaaaagtcttaaatcgatcttcttctggaatctctttacggaaatctattttcacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttgtctttaaaataaccttcatgattaataaaatctgggaaatcttttagttgaaaatgtgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcctcttctgataacactttacctgcacttgctcccgctctcctaacggctatgtcgtagtctttactgttgcctaatacgaatagtcgattttctcctaaaacaacaggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaacggaggattaccgacaaaagcagttacactaccaacagactcaacagattgagctaaaaaatctgcctcaatacaatcttcaaacttagggtcaatatcaaaagaagttatgtttttaaaacaagaagagaaagccccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcgtcagaaataaccatgtttttggtatttttaaagatgatatctactttaccttcacttacacgacagaatgcaacaccatctgcaactttatcgatataatatttgtaagaaagaatacccactttactacgaccagcaccttttgtgaaagaagggcttacatcgaaacggaaacctttagaagaaacaacacggtaagaacgtccagttggaagatgttcaataacagagacattattctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtctcttccgtaaagttgtcaacaggtatttttaataaaagggccgaagcccttaatagttgctatccgtaggcaaattagcaggattgttgaaatactgctctttgtcatgcagagttgcagttctaatgtcatagtaaaactgccctgccggaccagtttctgagaactcacggttttttaggataaagcaatgagtcgtattgcgttctacagggtcttcagcggctttatctcgttccaaagccaaggtaataccagcacctttagccaagaaactactacccattgcatcgtcctctgttaagtgttcattgccaccattagccgatttcttaacgtgtgagatgacaataatagttatagcatactctttcatgatgcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacataaaaacgtggtgatccatcttctctttcgtaaaaatctaggattttttctttattctcttccaagatttgaaatttctcttccggtgttttcctgtgtagaggaatatgcaggaacgaggacaacaggttacgagaatatttcttataagttgcttccaaggacagaatacctagggtatgttctgggtgcgcaacaataatatgtttggtgatctcgttcaccatcaaagttttaccgatactggtctttgccaggataactgtaatctcttcctctactaaaccaccacccagcatgtttgcagctacacgcataaaaggaggcaaggtaatcatcttggattccaagcattctaatgcagcttcatacaagacattagaagcataaacacctgctggggtgtatagacgagcactccaaaaagcttttacgaaatcttttgcacgaccttcttccagatactgattggcatccttaagatccatctgcatacggtagactttgttacgaggcagcaccttaacaatattttcaaatgcctcattacctgctttgtcattatccatgcaaacaataatcttcttaaatttttcaaagaaaggatattgtgcctgaacttgtttatacatactggtttcaccagttgtgccactaactactgctggaagctcatatttgttgtccaagttttcagacagcatttgataagctgccagagcatcgtgttcaccacctgtaattaccacagtgtgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatccccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacccttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagagccttcataaaaacgaataccgtcaattaaaagccctccgtggtaatcccaatcactttcacgagaaagcgggttaggctcttcataatagtaatccacctccacgactaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagaacagatcaaaggtaaacccttagcacctgcctcaagaattttaagattgctttttgcattattaaacacgttatcaagcaatggcgcaagactgatttgatgaccatcgtaagattccatgtagttggcatatggtcttacaccttcataaacacaagttggtgctacattttctctgatcacagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagaccattagggattatgtgcacattatcattgtattgtgaaagttcaacttgcaaagcaggtgtcgtagttgtaacaagatcgctgtgctctaaaaaccattttaaatgttcacgaatacctgattcaaaaataccttctaacatgtgtccttttggaataactaaagagtcatccaaatccataaccattttaaagcctaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaactcgtttgcatctgccagattataatgtgttcgaacatgttcagccaagaacaagccacgatcttcccgatagtttggattgcgaagaagcttaacaatttcgtaatgccattctgctttattctctgcgtaagcaacagcgcgagcatctacagggttaaaataaggtaataccttagaacaaacaattggaataccttttgctccagcttccaggattttgagattacttttacaattattaaaatcattatctaccaaaggagctatagcaatagcatgactttcgtaaacactcatgtaattatctaaatcttttacagcggctttatatttggcatttggtaaatttctgcgaatcttaatccactcttgtcccgtgatgctttgtgatgcttcatatcccgcaatagtaagaagttcatcatcgaaagtattagagactagtcgtaagtctggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaattaccacatcagcaagcttaaccatagctacaatagcatgagtgtttgactcgtatagacttgctaaataatgttctggattaagttggtaaaaatcatctaagtctacaacaaccttaacaccttgacgtttcaaagataaaacgtattctgcacctttagagtggatacggttaaacacaacaacatctttcttaggttgaatattattgttgttaaatggtataacaatacgatgatagtcacaaccgctgtgaggttttgcatcaatttttagtttagaccattttttatttgacatgtgctagtgcctcctcataggaaattcggattttcccatttttaatatcctctaaagatgctttatattcttcccagttaatcccaatagcagcctctttctcttcttttgtcaggttagcaaaaggcataggattgtttccaaaaacatcgtctgggtggatataagccatgatacgaagtggacaaggtgttgcctgaataccatgattcaaaccagcagcttgcaaacggtgtccccattcagcatcttcaaaaccataaccgtgagtgtaaggacggaaataacccatcttctcaacaacggcacgagaatacattgcaaattgacacattgcaagttcccagagaataacttctcctttgcttccaacaactttatctttgaaatactccggcataccaaagaaatcccatcctccagagacagcttgatctacaaagtatgtttcccatccctccatgactgggtagcaatcatcgtcaaaaataaaccaataatcataaccttcttcataaaactggtgcataagttcattcctggcataagctacacctttacgatctggatcgttgaatactcgaaaatctgcacgtggatctgttacaaggtagtctttaagtggacggacacctacagtgataacacccactccgattttaatattttccattttctctcctaaatagttttactgtgatcatgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacatttactttatgatattctcttgcaatcttagcatattctatatggtttagaatatctggatcatcgttaatttggttagagaaaagttgataaccactgcctaacctgttacaagttgcacctattacatcaaaaggcgggtttgacataacaagctcttcaagcatagatggttgatcaggtaggaggaacattgtatcggtatctcttaaacacacccaactatcatctggaagaacggcaatggcttcattgatagccttgccgatatttcctgtcagatagggagtaatataataaatcattctcccctccgttatattaactgtcagctacaatcccacgtttaatcatttcttgttggatttggatcacacgatctcgtgcttccatatattctttaaaagattcttggagatggtcacgggctacgtcccgtagtttaatcagtttgtcgtttgtcacttcttgaagagagatctcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcagtgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatctcccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgttcttatattccgtttcttgaagtatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttaattattacggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaaccagatgacgtgcagacagcatttcaggattgccagcggcattgtgacgacaaaccagtgcacttacatccagatctagtttagaatcagatttccaagagaattccaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaatgccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtctggaagaatacaacaccaggggtaacgtcagcacctggttcagatacagctacaactttttcacgctctacagacactgtttcagttttaccaagcagacgattaaagaagcctttctttggagcctcctcttgtaccacttgtttagtggtaatatatttagtaacagtgccaaaatactcatcgtagatatccgccattacaggggcgtaatttgttccacctccgatacgaacattacgcatacatttaccaacataatcatcgtaaacatctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcgttcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacagatcgcactgtttgtggaatttttaatgaacaccaagttacggtaggtatccaaccctgcgtcttcataggcatcataatacatgaatgtggcccctacgtcaagatcttcgaaagcaataggtaaatcctgacttttttcttcttgaatattgaatctaaacacgcatacctcctctaccaattttgaagcccaaatcgtaagcttccttagtgatcttttgtaactcacttataggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttaccccaatccatagcccattcgaaccgttcacgaacgccgttttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaagagtctccataagttttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacacccaccgtcatcatctttcattacttcataaacttcaccacttgttaacttgatgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatgcctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctctatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcattcaaggaacgcaaggttgttcctgcctctgccccaatctcttcgatctcttgtcgggtcatagaaggcaaaactggaacttcttgcggtgccgctggtgcataaacaggactggcatctaacacgcttggagcgaatacagatttacttgcatctgttgttgcagcaaatacgctcatttcaggcttcttctgaccaccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaattctgctgccagtttttgccaatgagcaccgtgcctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcacgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagctacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgacctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcattttgactattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacgatcataacgcttaccccagggtaaacttttgaaagataatctaaaacgtaatccacatcaccagataaatcccaaacaagttcttgaatttcatcaaaattattcataagtctctcctataaaatagcctcccgaaggaggctcatctattaaacagcagcttcttctttttcagggaagataaagcttgcaataacaccaagagctaatgtgcctagaacaatcatcagacttacgttaggggaaatatcatgcgggaggaatgaccacttggcatgaagtgtttcaccgaacgggtgatacataagtttagcaccaacaaacaccagaaccacagcaacagctttctctaagtgaaccagatatttcacagctacacttaacacaaagaaaagtgcacgtaaaccaagaacagccatcagcattgcagaataaactagcagaggttcttgtgtcacaccgatcacagccggaactgaatcaaaagagaagacaatatctgtaagctcaataacaaacacacaaagaagagcaggagttgcatatttaataccattcttaatggtaatgaacttttcaccatccagtgcattgtgcacaggcagaactttacctactaaacgaacagcccaatgcttagagtaatcaatatcctcttcttcgtcaccacctttgatgatagccacggcagaccaagctacaatcaaaccgaacaacacttggaccgaccaatgaaggttaaacaaagcggtccctgctgcaacaaaaatacctcggaagacaatggctcctgcaatcccccaaagtaaaatcttatgttggagatgtgtgctcttaattccaaagcttgcaaaaattgccatgaacaccatcaggttatctacagaaagactcttttccaacacataaccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaaccaaaacaactacatcaataatggggaaaccaagttgcattattttctcctttctctttgcggggaaccactccccgcctcatgtgatacatcttactctattctaaaactttgtcaacacttattttgaagaacttgaggaaaagatcccacgtagtacagccatgataaatgccacacacaccacagtccagaaggtgacaggaacagtgatatctgtgtgacccatcatttcaacaacgtagttataagccagcagcagaagccatgctggaatcatactaatcagaaaagcaataacaaacacaataatcactgcaagaatacctgctaaaacgcccataatatttctcctcttaaagtttataaatagtcacatcgtgacctgtttttactaaagtttcttcaatcatcacttggatgatagcccaattacctccagcatgtccagcgccaatcataggtaagccgatcttacatttttggtcacggagaagcaaatcgttagccatagctattagtgcatcgtaaagtgcatcatagtccaactgacgacctttagcattgtatccgtaacggtattgcccgtatagattatataccaaagggtctgattgttcgtctggcacccctaaactaaaacaacctagtttactttgatcaccagccattgtgtctaagtctgctgcatatgcgtaaggaaatgctcgtttgatttgtggggcaatacctgcccccatattacacatacagttgcaacaatgagcaataacagttacttcacctgctttagcggcatcaataagattacctgttttcattttaagcatttttagctccttattacagaatgtgttgttttgtgtaacgatccaagaattcaaagttttcagcatactttgaaattcggttgtaaccttctcccaagcatccaaagaaaagttgctctacatagtaatgtggcaattggctaagaatgattttgaagtcttcatgattttggccaataagatacttaataggacgaacaagacactgtgcatcacgttcttcattaatcattttaacaaacgcttctggtgtattaatgtagttaaaattcagtttagcttcggtatctgcttgattacctccgtattttgcaaaatacaagaagtaaacatcatttttaacttgattttcatcaaggatctcaatcagtttgtcttcatgcgttccagtgatatttacatcatcaatgaatacaagcttcttatcaccccagaattctttgttgcagtagaatgtatccccatcaataagtttcttacgactagctttatccaagaaaccataatcgttgatatagctaactttacgatgaataatgtccagttctgctgaacgaccttgatcatattgtgattgcaacatattaaaataattaataaaatgatctgtcatcattgttgcagcattatgcacatggttataaggagaaggaatgataacaaattgttccccaatatgtttcattgccacttgagcaaaaaactgaagtgccaattctttacccatacgacgcgcagcttggttactaccaaatttcaattttgaataatcttggatatcaaaagtagcagtttccaggtcatcaaatttatttgcaaaaatttgagtttgattacgcatttacaatttctcctcttttaagtttctctagtaagtcgttagggttcttaatatgacagaagttaaatcctaagtcaacacattttccatcatattcttcactatcgcctacgtgcaacacttcgtgccctaacagagggatcggagaatacgtgagcgtgcgagcaaagaatcgcggatctggtttacaaagtaaagcttcatccgagaaatgggtgaactcaaaacaattccaactatcaaacttacaagcacgacgcaggatatcccctgatatgaagttggtattgctcttaatactcaaatcataacgccccgaaagatacagcaagtacatcggtagatccacagctacatgaggtggaaacttaaggaaccattgttcacactcgaaacgaagctttgcagacttcaaaggtgttatcccaagttcgtaaccaagtctttcccaggcatatgctgcacactcggctgttccctgaagtgcagcattgtccagttccttcttgatcttattgtaagctgctctcgcttctacttccgtaatatctccatattttgcgatagtccaggctcgcatgtctgcgtaattggagtttgctgtgatcagtgtgttccatacatcaaaagagatatgtttaatagtcatattaagcccaccatgcgtctaagttaagattactatccactaccacttgttctatgtggtagccttttatctgtatcccactgttcaagagcatatcatacgcttcattgaaacgcaacttatcttctgcggaatataagcgagcattataaaatcggtaatcaacttcttcagcattagaagaaatacggaagaagtttgtttctacttcgggatcatttgctgaagtcttaatgtgaacttctccgtaattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatattttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcagggacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactctatctcctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtaaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattactaatctgtgcaaaacctgcttcataatcccatttttcaaaaggatttgttaccaaccatacaggttgatgaaaagagttagtaagatagtctctttctaccaaacctgggtatttttcatttaaagctgttgcaaacttatagcacaaagattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcataaccaccttcaaacaaaacaccaatttcatcattggcatttaaacgcgctaaagccccttccatgaaaagaatagggttttcagatgctttggtatgtctgatacggtttacacgtaacatgtgagcatcgtaggctatctccatatgtttattaaggaggtcggtgaaagattctcctttacttctcgcttccgcagcgatcagaggtaagttgatagaaactactccaaggttgaatcgtccatcgtatttttctccttgttcggtggcatagtacgacaaaaaggaacgacaacccatactcgtaacagtgccatctgctgatcccgtaacttctttgttcaaaggaacagaaataaaatctggataaatacgatcagcacaacatgccaaagcttgttgcttaaggtcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcgtatacatcttgttcggtcatttctagggcttcttcccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtggtagctaccccaatagattttggtttttctatctgtgcagcaccgatcttaaaaccattttctaacatatcttgataattaacaagacaacagtttgtaagaggagagagcagataatccaagtcgtgaatatgtccaaaaccttctgtatgccattctgacaagttttttggcagtatctgtgtcattgccatatgtttgcttaaaattcccgccaagagatccctgtgtgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcgtttggagaggaattgtcttcccatgatcttaccgttctttacagcggtcccatcgtgtccattataatcccaagttccatcaatgttacgcaagaagctatcacgaacagtgtaggctttaccgttctctactttactttcttccacaatgattgccataacaagcttattttcaatttcggtagtaaccgattctttaataccctctgtaacttcacgatcatattggatataaactcgctcctcggtcacttgcacgtctaccacatttttaaatgtgtatgtctgctgtgtagtgtaaaggacacgaacaacactcttcttacctactggcggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtgttcggcagatattcaaatgcagtatcttccgctacaaactgttcttcctcttgctcctcaatacttggcacaggcgcagcttcatcgtatttcgcagcaaacatatttttaaattcttgggccgtgacttctacaaggccgcgatcaccagtagcagcagagtgtgggcgtggtaaatccccaacttcaatatgcattgcatctaaacctgcttgacgatcaaagaagataaccttgcggaattgtttatctttatattgtggcagttcatacatacttgggtcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatccactaaataaggaacatctaacatttcagcaaagcgtccataactctggatggcttcggcaatcacacctgtgttcatgaccttcctcctgtgcgaaacgcacgtttagtaatgtttgacataatgatcaaatcttgtaaagtcatatctgggaactgttgttctaaaactccctcgacagcacctataatatctgacaattcaacaagttgcattattttgcaatcctgctcaacagcatcaaaaagttcttctacttcctctttaatcttttctatgctgccataaggttgtttcttaatgtctgttatgtgataccccgccatttaacgatcctctctgatttgattaatcttacgagcaagggcagctataagcttatcttcttcggatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattggaagggaagtcatttgcaacaataacctgatcccactccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaggtgtaagggagaactgtctcatgcttaactttgtccaaatcgcctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctaccacatcagaatgaaaacttccagtgacagtatcataacctttgcctaccagcggatgcttcagaggtgaacgatcagaaaggatcgcattagcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaagtcttctttgctcaattcaaagagtttcacataggtgtcatgagtcataatggtttctgatttaggatcgatacgctcacgccaaagttgcttcgcatatttaacaacttcgttaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaagttctgaatcttgaattttttggcaatctcactaccagttccagctacgttaacatattgaccttctggacgagataatttgtgtcgaaggttttgtggaagacgctggtaacagattgaatgtagcgttcggcacataacgttaggcggcattttacgccgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctcgactaagattaccaacatccaaactacaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcttcttctccattaaggccagagaaagcaggagtaacgaaagttaccatataataatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacaatgttgcttgtttgtcttgtagtgttgtgataccaaacacatctacatcaataatatttttcaaaaattctcctcccaaatccaataattgtctacataagtaggatgccttttgtcccactcttttctagcccaagctacggctgctaccaatacatctccatgacaaggttgaggtgagcagaagcaaactaaatctttcccttctaactctaataaatcttcaagagtgatcttaccacaacgaatttgctcccacaaccactctttatacctttgtatggttgatcctcgtggttcatcatcttttaacttaaaaggatttgcaaacttagaggcttttagtcccatatgtggcattgctctaccaatataaacagcaccctctgggattgttttgcctaaatggtaaaagtttaataccttcatattaacctaaacacatacgtgcgatcagaccctggatgagtttatctgcttcttcgcgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagcgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttagcacaatgaacaacacctttctgttgtcttgtggttctttgactgtaatatataaatcttttgtgcaatagaaacctgtggctttgtaagcgtcaccccaattatccactccacgatctatacgatcaaacttacagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaaccgcgtgaatttacgtagtagatttcatcctcaccagagaacatccaatccttgtctatcagatagaaagctaaactcacaggcgacaactcatccttcacagaatcattgtacagcatgtgggctgcaactgccaaacttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttgcacatgtcaagtaactctttgtcagattagtcttaatgattggtgatgttgatgacaatcttagtttcaaccttagcccaacagtaatctgcttcattaaaacgactagtcacaatgtattctcctgcacgagaacctgttaagcacactgcacctgtatctgtagctaagtagtagtcccgttcttgttcacttacttctgaatcgtagtagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcggggttagggtagcatattttttgaaaaaagtcaacacttattttttggtaagtagataaatcaattgttcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgctttaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtaccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctccttcttgttggctgcttcaatcatagcgttaagagtctccataccgctttcaactgcttgagcaatctcttggaacacagacttcttaaagatgtataaagaccctgcctgtaagcgttgcacacaacataaaatcgcttggtgatccatcaggaagtcgccgtaggctgaatcaatcttacctgtaattgggttctctcgtgaacgaggatcgtattctaatgtgatatgcgttacaccaggtaaagtaacaaactgacaacggatgttgacacgtggtgcaattgacacgctaaacaggctgtttgacatttaaacctcctcgtagtaaggcaaagctttaatcaattgttctgaagtaccattctctatccacgtagccccgttgtcaagagaaacataccctttcttatcgataaatttacggagacagccagtgaacttgtttttgtagatcatttcttctttcctttctttaatttgttgtgacctttacccttataaagcttgtgattacgagcagacgggttattttggttctccagtcggctaacaggtgtattccaaaggtttcctgctacaaaagatgctgccacaagttcttccaggtatacaaaatccaaagcaggtatctttgtttccctcatctcgcgttctacattagacaacacgccttcttccttactatcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgagccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgttattgtagccttgcacggtaacaacgagaaatggttggcttcttttgaagaggatcgtcaacacaatatcattttagacgctcctataaaagttatgcatatccttggtgaaaacaaagtgctcacttcctcccgttcaaaggaacaaattacaaacgaattagtaaaactgcttgacaatgttcttaacatgttcgataatgcacctatcgacacaaaacgtgtcttaatgtgaaaggagaatataatggcttaccctgattacattgacgaacgtgctatgggtttcttccgtaacttcttggttggtcgttctcacggagacaacggttccagttataaaacaagctgggatagtcaatgtggcgctaaggctaccaaaactttgaaaatgccaggtcgtccgttgtgcgcgtattgtggtaatgaagccttagctcttcaacctggtattgaacatggtgattatactattaaaggctacacttgtgtctgcaaaggtgcaatggacgaggcggattgggtgaaagaaaaagcagagatggaggaacgtcataaacgagaagcttatgaaatggaaaaacgtatgcctgttccagatttgcaagttaagaaaaatattgttgcgaaaatgatggaaaaagtccagaaagcagagacggaagaagacctaaatcgtgcactggaaaacttacgtaattttaaagaagaaaaagagttgcgtgagattatgtggtaaggtatactatttccatcaattaagagaggagaaccaaatgtattattcacaagacgaagtagcaaacattaaactggcagtgggcgatcttattgtgtcacctaactactattgggataacacagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagctttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacggttagagggccgtcttttattcgctagttattttgataatctttggagctaaatatgtctgaattcttcacaatggctttcttagggatctatctgattattagtgctgttggcttaatcatgtctctaatagaggaaatgggaattaagtggaattgtgcattcggtatagctcttatgctcactccagtttggatttacatttgcaaatcggttgaactaattggttagtggaggtaatatgtttagtaaagaaatgagagaggtaatcgctactctggtagttgatcatggtattgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggataccatttgtcgtaaacataatattgaaccagaatacgggagtatgtaatgttaagcatcaaacctaaaatgattactgaagatcaaaaagagtacatttataaatgtggtcgggtgtggaaagaatacactaaaggtaatgaagttattgtagttacggaacatgctatttctttatcagatctttttggtgattatttgcaagtcattaaaattggtattgacagaggtttggtgcaggtgttaacattatcccaagttgaagcagaacacttagacaaaatcattgtcgagttctaagaggagaaagaatatgatctctttagaatcaatagcttttaagaaagggtataccgcagggttcaagtttggtatgtttaataaagtaaatccatactgtccaatgacacacaaaaaggaattcgaagaatgggaagatggattttctaaaggctaccaggcaaagggttggttgtaaggagagaatatgattttaaacttcatcatcaacttgtgtttgacattgggactactctgtgcaatagtatcccctctggttggtgaatattgttctgaactggcgatgtttatagttcttggtgcggctattgctaatatgtttgtcgctgcgatttgtatgttgtgggaataggagggaagtttatgaaaaaattaatcttagccacattgctggctaccgtaagcttcaccacttacgctcaaaaatttgtagcagttaaaacggatattggtaaagatgttgtgatcacaggcaacaaattttactatacacctgggaatggtgttctagaagagtgccaagatgttgaggcatatacaggaaaagaagataacacggaacgtcctttttattcgattatagccacttgcaaaaatgaaatagtagctattaaacaatacaaagatgcccctggaggagaatacttattagtcaagaacattaagagtgaaaaaactgcaaagtttacagtaattattttaaaaggagaaacgttctaatgaaatacactatttttggagatgtagctgttgtaaataaggaatatggtgttgaagctaataaacttcctgctggagtttgggttgtcaactgtgatccgcacggtaactactctttagtgcgtggcgaaagtttctctcttccgaacactctttatggggaaactaaagaccgcgccgcacatgttattaaaacatttgctcgtcgtagtaaagaaggtaaaaatactggggtgttactgacaggcacaaaaggcagtggtaagacgatgttagctaaactaattagcatgtccctaatgtccacagaaggtttaggtattccaaccattttggttacacagccttacacagatgctggattcttagaatttatgagtaaaattacagatcgtgctgttgttttatttgacgaatttgataaagtgtacgctaagaaagaagatcaggaagcactgttgaccttgttggatggaacaggaagtgggaataaactttacatcctcactaaaaatagtggctatatctcggaatattttgtaaaccgtcctagccgtatttattacagtttcaattacgataaactgtctagtgaaactatgttagattacttggataagaatttggtaaataaaaagcacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaacgatgctaaatggaatgtggcttctatcgtagctaatggcaaaacgctgaaggtgaattggatcaataactggcacgacttcacccctactaagtttttgtcgggtgcttgttccctaaacatctatctacaaagcttgaaagatgatgaagtggaagcaatggaaaccaacagttatgttatcctagatgaagatggtgatccacatattgatctatgtgcaacggcggatggtctaacttgtgatctgattgaaggtggtaagattcttgtgatgagcactacaccaggaaacactttgcgagtggtgctggagcctgtaacacaacgttccactacactgggtagcgtgttctgatacagcacaaatagctaaacccgcttcggcgggttttgttatattgatttcagacttatagggagagaggatagacaaagatggcgaagacgttagaacagtatataggagaatgtaaaccaatagcggaagctaaaggatatgagattatagggattgtagagccatttaaaggtgtgcacacgaagatgatcaacttctgccctaatcatggggagtggagaacatccacatttgccaattttaaacgtggtaagtctggttgccctgggtgcaaaaatgagaaggcaagacaagacaacagtaaaaacctagattattacctttcggaatgtaagcctattgctgaagctaagggaatcaagattttaggcattaatggagagtttataggtgtacatacaaagatgatcaacctttgtcctgagcacggggaatggcgaacattaacatttcataatcttaagggtggtagtggttgtcctaaatgcggtaacaaaagatctaggaattctaaaatactcccagacgatcagcacatacaagacttcattaatacaggaaagtttaaagagggtacaatcttcactaaaacagataaaaaacgaggccgcgattctttatggtgtgtagagtgtcctgcctgctctcacgatgagtatgtgcaagctggggtgtgtgatggtaagttttatgtcgcagggaatgaccttaaacaagggaagattccttgccgttgtgcaactaactgtcattacacagaagcacagattacctatagggtaaaaaaggcagtagaaaggaaagggtatatctgggtaggttggatcgggaaaccgtctgtaagattaggtaagtttaaatatggatgtaagaaacatggggtacaaataggacgtgccagtggtttgttaaatcatggtactggttgtccgcaatgtgctaaccagacacaacaacaatgttacattaaccacatccatgatgaacaaggtattctctgtgctttgaaatttggaattgccaataatagtgatcgccgtatcaaaaaacaaaatagtcataatgtgtttactatgaaacaggtccaagtgtggcacttccctactgtgaagcaatgcaaagatgcagagaagcgttgtaagcgtgtccttcacacggaagcagtgagcaaatatgctatgccagatggctacacagagacagtagagttatcttgcatggcctcaatacaaaacatttataaactttatggtggaacattacaggaggaaacatgttagttgacgttcaaattatgcgcaacgaaagaatggacttctttgaagcagtagagaaacatctgatcagatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgattatgtattcttcttttcacataaagatgtttttagtaattggtatattgcaccctttacagaaaccgaaccaggttacaatcagacatttaattgtgtcgaacaatacatgatgtggcgtaaagctttgctctttaacgatcacaacaccgcacaagctattctgactcatagcttaaaacgagaagatgagaagatacaagcttattacaaacgtatgggtagggcagtagcaggtttcgataacaaaatatgggaagagaatcgtgagcgtattgttatgcgaggtttatgcttgaagtatgtacagaatccagacttgtatgccgatttacgtctatatcaatacaaaacatttgttgaagcaagtccttacgataaggtatacggaattggaatggggatgtatgaaccaggggtgctaaaccctgccacctggaaagggcagaatcttttaggcaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctgttattttgtcctatacaaacccttatctttttcagtttgcatcactaggattcgatctaagtgggttcctgaaggtttaccaataagattaaaggttatctcaaattcccactacctattatctcaaaaatccctcaaattatttaaactttttaagaatttacaaaagtgaaagttgaaaaccaaaatttaaagtttaggaaaattatcttaaaatgttagatacaaaacaaaactcaaaagtcaaggaaaattttaaaaattttgcgcgcccacagtatttaaagtttttttgcttttacaaaaatgaaagtacaaaagcaaaatttaaagtttacaaaaatttatgcagatgggaatgagaagagttctcatatggaaatgcaaatgataatgattcgcatttaggtttataaatgagattgattcttatttgataaggtaaatgataatcattctcatttagagaatgacgcgcaggggcggtgtttgtctcgcgctcccgtgtcccctcgccatgtaataagaataacagatccagccaggaaagcaagcgattattttatctttacatttctttacaaatatatagcgcccagcctaccggcgatcaaccttccaaccagcgccctggtatgttagccccgcctttacgccgtggggtggcgcttcctcttctgtatgtaaaacagtataagcccgatccctgggcttgtcaagattattttttgttttcttgccaggaaaggacacctaaccaaaaatgcatatcgccccgcgcccctggtgggatcttgctttccccgccgccactgcaagcccataaataaccatcagcaaacggatcaaaatggtctatctcttccaccttatgatcgcccaggttgagaacggtttcaacctttaagcccgttgcgcttgctacctggtgcaccgtgccgccttgccagcccaatgagtgcataaggtgtaatgtagtatttgtcatggtgtcgccctttctttgttgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaagatcatggcaacattgcacattgtggcgaaagctggacaaatcaacgtaatagtaaacggttttactgagttcagtcatccccaggatgatcatgaaacggttttatctttcattgattcactgttagaaatgggagtaattacagaagatcagcatactgcaaaatgcaagcgcgttaagcagattgtaggaatagaataaaagtcttgacaacaagccacaacctgataagatgtatcacatagggcggcggaatggtccagccgctcacaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaaattcaataaacaagattatctcggtttcgctattgaaaaaaccgcgcgttttgttgattataaaagcccaaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggcgcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcacgtagtaacggcaacgtaaaagcgcgttatgtgcgccctggctggctggcaaatggtaacgctgatttatccagtgcggaagatgcgagcgacggcgcgaaagataatcctttgtacaaagttgatccggcttttcgtgtcctggatgaataccccagcaagatagcggcgcttgatgaagcattagaaagtaagcgcataacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttggtgtattgatgcttttcctgattatcagccgacagaggaagaaaaaaggatcgcactagaaaactttgaaaatagtctttgacatatcgccgccactggtataatatttaccacgtagggcggcaatggtgccgctcatagtgaaattatgcaagaggtttacaatgattaataaagaaaatagcttgacggttggaacgattaacgctatcattttcgccgttccattttgggttgtagtagcggctattattttctaaaaatattcttgacaacgttttttaatctgataagatgtatcacatagggcggcggaatacttccccgccaaaacaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgctacttacaacaaggcggtacctggtctgggaagtaccgaagagttgcacggcttaaacttggatcagaacacttgggatagtatgcgccgcgttatggtatgggccgaaagcggtaaaatttacgaataaaaacggttgacactgtttaaaattccggtatagtttaccacatagggcgggaagtggtttcccgccaacaatgaaaaaggttatcatcatggctattaatattaatgtttcctcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgttaaacgtaaaaaagatctataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgctaccgtttgaaacaggatggaatcactacaacgccagacggctttaagtatagtaaaactgcaatccgcgccgctatggttggaatgtaaaggagacataaaaatgaaacatcgttcgacctatctcacaaaacgttttagcttagatcataaattgggctattacggaagaaatagaaaataatttgacaacgtttaaaattagtgtaagatgtatcacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggagaatatgcgagcgtcgagtacatcgaatcctaccaggtgccaaccatcagcctaaccgatctcaacattgatcgcctgttatgcctggatgaattaatctgaaaaagattgttgacaccggaaagaaaaagagtaaactgtattacgtagggcggcaatggtgccgctcacaacagaagagagattatcacgatggctaatatccgcacactgttaaaaaatgcaagtcaagttttattttcagatgacgagtatttcaataaagacattacaggcgtgaaaaatttaaaagacgttaaggatgtaataggtattcgcggatctttacgtaagggcgattactacggtaacaaggtgcaatataaactgtcaaaagattatgattttactttgacaattatcaactaagggatcacaaaatgaaaacttgccaatgtggtaaaaagtctatctctggtttaaaacgtggcgttgctctttgtcaataccactataacgctcaaacgtggggtaagcagtgggcggatcaggtggaagaggcaaagaaagaaaatataaaagtagttgcaaagaaataaaaatagagtaaactgtattacatcaaggcggcggaatggtccaccgcctaacaaagagaagaggaaaatatcatgatcactttcgctacccgtgaagccgctcgcaacgttgcacgtaaagttaacgccgccaacttgggcgctacgcttaaagcccctgtaaaagatgaatcaggaaaatggatcttccctggtctgcgtcatgctgacaagttaggtactttaagccttaaaaaataatcgttgacttttcgttatagcgccttataatgggcgctatagagaagagaaaccactattaacaaggaaacatcatgattacttttgctattgtcgccgttgttgctggtcaggtttacgtaaacgagacatttactacagaagacaaggccgcaggagatataaccgccgtttacaatgagtgcaaggcagtagaaaggatgttatcgccttgtatgctaatgagtgaacgtcaggatgggataacagtatttactaacattgaaacagggtaccaaatggtagtaacaaaataaagcttgacacggatttaattttcagtaaactgttacacgtagggcgggaatagttcccgctaaaaagagagaaagaccatgaaagcacaaaatgcaattaaagagtacatccttgccgctatcgattttaatgattatggtattacaaccgaaaaagagaagatcgcggaattgatgcgccgttttaattccgagtactggtaccctgataaccaatcacgttttaattatagtattgttaaagcacttgcatcatggttacaaggtttgccatcagatattaatatcgctttcgaatattgggaaattgatcgcttgttaacatcctggggatacattaaagagaatagcagcgatgataaaatccaacgagaaagggaaaattattggctttatattgcaggcgtgatccttgcttgctcttatgaatgataaaccttgacaattttacaaaacagtttaaattaataatatagcggcaatggtgccgctcatataaagaggaaacaaaatgaatacatctaatcgcgcagaaaaaattcaatcttccaagatccgcaaggcctggaatgaggaagtgatccgcaaaggcgacaagcgcaataaaacaaagcgcgggaagagtgacaaatataattggatggatttagagaattaacataacaa

SEQ ID NO: 22 - DNA, 72689 bp, Unknown
  Podoviridae; G7cvirus
tggctggggctacacccttacactcaactagcccccccggtatgttgacggtgtagccactaccctaccccaccttacacgttacacatgctccgcatgttatggacatgtcgtcctatcatcaactattggagctatcatcatgactactaccgctactgtacgtatgaccgcaggaactttacttggtactgttaactcagctgctactactgttgcagatacatttggtacagcaactaaagcagtaggtatgcttaattcatatgtaagtactatggcagagaaacaagccatccgtactaaattagaaatgcatacctttgttaataaactggcagaggagacagctatgactgagactctgcgtaagaaaagtattgaagaattctgcaaggataaagagaacgctcggatctataacgcagaatattcaaaagtaatcgacatcctgactaaaagctaagtcacataggaggctcttcggagtctcctgttttgaacattagatagatagtcaaaagtagataaatatctactttaggagaaataaaatgtccctgacagattgcaaatctgaatctccgcaggaagcattagaacgttttgaagaagccgttcgtcagcaagagcaatatcagtctgacatccatcattatggagaatcagacatagatatctcagacgaaactgtagaaagtaagtatcagaaagctaaggctgaattactaacctggttgtcctacattccgtaaaaaccaagacgctccgcgtcttatggatgatgtaaatgcatccactaatcattgaacttttatccttttgtttgggtgttctcaccgacgagttcacccgtaaatcacataaatctggagagtacaaaatgtctattcaaaaattcactttcggtcaatctaacaatgctgctacttctactactaaaactgataagcctaaagctcagttctggctgaacattggctatgtagctaacgaaggttctgatgatgagaaattcatctcattgcctactggtattccgctggatactcaggaaccgctgcctactaatagcagcaatgctgacttccgtgctatgcgttgtgcacagaacgacttgctggaacagttaatcgaatatgctcagaacctggaaccaggtgaagaaggtatcattaacctgcaagttcaacttcgtcgtgtgaaagcagaggctgctgacatcccagcagacgagaataaatatgctcgtaaactgactttctaatcaaccactagactcccttcggggagtcttttatttttaactagacgataatctatttctactttttgagtatctttagacgaagggtactgaaacagtaaccagatagatatagatttatattagatgaaggagtaaccattatgcgtacagtatgtaaccgttataactcacaaaagttgattgttatgttacaaccttggggtagtaagatgtctcttaatgctcgttggcaggtatctgtagaagataagaatggtcagcattatgaccacttctttgtagctaaacctactcgtaaacaaatccgtaaacttcataaggtgtaagactatgttggacttcattgcgtttgtaatactctgttatgtgctgtatcgcctacgtggttacattctcaatggagccaagtgggtaagaactaagctggtacttatctgtaagttacctgttgtattcgttaagtgtctgtttgcttccatcgtagctaaagaggtacgcaagcaactatgggctaaagaagcagaagagtttgcaaagaggaaccagtgatattcactaacatagaagatgccattgaagagtgtatctttcgtagatatcacactggtgtacagaaacgacactatggtgttgtgcaactcaatggctatcaaatggttgtaagaattgtacgtaacagcaaaccttttaactttatgtggagtactaaacatgcgtaagtcattaatcatgggaaccaaagctgacgtacagagaatgaaggaacgtctggctgctaagcaacagacatctgaaccagtacgtaagattgttactttcaatcataggtgtatcaaataataaggagtcctccaataggaggctcctattttttatttttgaatagttagatatgtatttaaataggagaaataaccttgaatgaaatagtatgtatacttcctcaccaagctaaagtagctgacaggaatatacgggtacatttaccattcccattaagtaatccatttgctcgtaacgaaagaaccacggtagaagatatagaggtagcttatgaggcttaccttcgtaatcgtcttattaatggtgacaagttaattacagcagagatggaaaggattgctggctttgtaactgatagtacaggtaaacctgttggtttaattggtactgaatctgatgttaacgttattcgtaaaatactgatggaggcactcggtgaacaatcttagtgatgtcatcgtagataaaacaatattagtaaatcccaaagggtatgcctggttcatgctaaagcatacccgtaaggtatatgttagaaaggtatatatacgtaactttggtaagttatcttacagagaagtacgtattaataatgagatgtactttctagatgaatcagtgattatcaaatcaactgaagacagaaaggctccttactttaactattacggattcaactaaaatgatgtactcaactgattatggtgtttgccctgtatgtaacaaacgtaaaggagttgctaatcataagcgttgtagtcgtatattacagaaacaacggaaccagaaagaatgggataagctgttggaaaaccagcataaagaagaaaatcaacagatggctgttaaggcatctactcaacgtattcgtcgtattaactatatacaggggtatcagaaatgagactaatcgtagctggtggaagagacttcgtaaataccaatcttatgattgaggaattacagaagttagtaaattcagtaaatatacctgaatgcccagaattagtatgtggtatggctcgtggagcagatatgcttgcatataatctatgggctaataacaaaatgcctattcataatttcccagcaaactgggataaatatggaaagtctgctggttatagacgtaaccaggaaatgggtgaatttgcagatgctgctgtatgtttctgggatggtaattccaaaggaaccaagcacatgattgatatcatgtataggcttaataaacccgtatacgttgtgaggtactaaatgattattacatatcctacaggcaagactgtggaatatatgaagcacaccattcaagtacctcactgggttaagtatatagctttattaccacgtcaatataaaagtgctaatacctcattaataggattctctaagaagcctaagctaacagaaaacaatatctgggtatcctctgggagacaagaagaaattggtttttgtgatttgagtattgtcgataataacatctatgggacattgagaaaggtatgaaaactattctagtagttcatgattctacatttacagatgtagataaaatgatgcgtaatattgattatgtatctcaaacaagccaggcattcaatgaagaatttaccctctactgcaatgctgaatctccactggttcctatccttaaagaatcaggtctaccattctctacagagaacttcccggaagaaccagactatgtaatctcattcatttatgacttacatgatggttctgaaactagtgaactagctatgaaccagtggcgtagtaaacgtcctgtgttcgcattccaggtacttaagccatgatttataaagaatattatgtattcaaaaagggggatgattttatagctatgccggatgattatatagattggcatacaactcccgtattaaatgaagcattttctgtacctaacctagaagaggttaataaagtaatgaacggggtaatgttaacaagagggttagcttacaaaatagacgcattagaaggaactactgtatgtaaagtaagtacatctattgaggcattaaaaccatgaagactattacattaggggacgacaccaatgctttgctgggtgtagctgcacgtccaattatcattgttaataaacatcacggtaaatccggtgagtatatcggacgtggttcaccattaggaaatccattcgttattggtaaagacggttcaagagaacaggttatagccaaatatcgagtatggcttaatgaacaaatcatgaggaagaatcaagctgtattggatgaacttaatcgtcttggtaataaagccattgatgagaaagggttggccttacagtgcttctgttatccgaaaccatgtcatggtgaggttattaaagagaagctagtaaaagctatgtataactactttgtggagaatccaaaggggtaactaatgaaagaaatattcgtattcactaccaatacactaggacaacataccaatgcttctgccaagttagcttataagaaacatggtgctcgttggggcatggcctatggtcactatggtaatagctttgctattccagtaagagatggcaatggtaaccgtatcaaagagggtgctatctatggcttcattgagggctttattgcttatgcatctgccaatccacaatgggatttcaaagtcatgagtaatgactacctggacccataccagttcattaatgtaaccggaaatgtactgttacccgaagcatggcgtaaacacttaggcgatgcttacaactactggagttaataatgacttatgaagaactgtgggctgctcaagtcagagccagagcacttacacggcatgatatctattgtgcattacaaaacgaactaaaggatcgtactaaactaggtcacatatctggtttaattaaaatacctatgcgtagtctggtatggccttaccagaagaaaaataacgagtttagtggtaatggtttatatgtacgtattgactaccttggtcaagagaacagtattcgtattaccttttggactaaacgttaggtaatagctgctccgcagcttttggttattaatcacatttaggagaataagcgatgtactcatccattgaacatcagaagcaactcgaaattcttttcaacaaaaatcaattactccctcgcatgaggaaggaatttgaggactccgaagaaattgactttaaggcattcgctgcctatttggaaattgattataagctgctcattgatgcaatggtgcagattgccctacataaacgtgctgaccttcagactatgattggctctcttatgagccattcagatgatgctcagtacatcgctgactgtctgtataagatggcagagaatgactgcttcaactatgaccctaccatcgacaagttcggtgttatctacgagattagtgaagatgttcagatggaactggaagcattccagtatccattacctatcgtaagtgctcctaagcctgttctgtgtaaccgtgatacaggttactatgagagcaggggaagtattatcctcaagaagaaccatcatgagatggatgtctgtcttgatcacatcaaccgtatgaataatcaacgtctaagcattaactgggacgttgctaactatgtaaaagactctcgtcctaatatggataaacccaaagagggtgaaacccgtcaggaatatgagaaacgtgttaaagcctttgagaagtacagccgtactgctaaggaagtaatggagttagtgaccaaagaaggtaataacttctcactgggtcacaaatatgacaaacgtgggcgtacttacgctcagggctatcacatcaactatcagggaaccagttacaacaaagctgtactggaatttgctgataaggagttagtaaataatgattaatcatcgtgcagtaaaagacttctatgcccatagggaattggtactaaaacgtatcaatgaagcaatgaaacgtgaagctgaagctaaacgtaaccgtaaataaattcaaatgcgagccaagaggactaatcccaatgagtgagttattaaaactatggcttattagccagaatgagcgtaaggggtgggatacgttcgactctgctgtggtagcagctaaaaccgcagaagaggctcgtcttattaacccagatggagaatggagtacatactccgcttggtgttcttccccagataaagtgcacgtcgagtacctgggtattgccaccgaaggtgtggaaccaggaatagtattgtcatcatttaatgctggctaatacatccaataagcaggctctccatagtggggagccaagaagcaaaaggaacataaaatgcaactgttaaccgctcgtgaatacctgaaagtagatattgccaataactatggtctggataaaaagacctgggatgagcgtattgcttggttcgatgagaatgaagctaacttgcttaatctggtagatgaagctgaggaatctgcactgttctatgctggtgtaaacgcatggaaagatatgaaagctggtaagcctatcggatatgccgtagccctggatgctacatcatcaggcttgcagttactggcctgcctgactggtgaccgctctgctgctgaactgtgtaacgtagttaattacatgggagagaatggtaagccattacgacgtgatgcttatacagttatatatcacaagatgctggacatccttggtgaagcatcccgtattaaacgtagtgataccaagcaggcagttatgactgcattctacggttcagaagccaaacctaaagaagtattcggggaaggtatccgtctcaagacttttgaaaatgtaatggaaacagttgcaagtggtccttgggcacttaacaagttcttactgcaatgtggtaacccggatgctaaccgttacatatgggtactccctgacaacttccacgctgtcattaaagtcatggttcttgaagtacagactgttaacttcttgggtaaaccatttgacatcactcgtatggttcagggtactgaagagaagacccgtatgctctctgctaacatcactcactctattgatgggatggtagtacgtgagatgctgcgtcgttgtaacttcgaccctaaactggttgcctatgtacgggaactgtgcgatatcgggccaagtgaataccccgttattgaggggaaccaagagaagactatggaaatctggaatcattatgaaaggtcaggattcctgtcgctgtctatcctagacttccttgacccgaatactattgcactggtagaccgtcaagtagtagcagatatgatcgacactatgcctaagaaaccattccctgtaatgactgtacatgattgcttccgttgccaccctaactatggtaatgacctgcgtcgtcagtacaatcagattctgtctgacattgctaagagtgacttactgggcttcattctgtctcaagtactgggacaagagttctctgctggtaagctggatgacagcctctggcaagacattctagaaacagattatgcattaagttaataaactagcctcattccttcgggagtggggctttattttttgcttggaggtagcaactatgcttatcaattttgaagtaatctctcagctaatactgatagttttatctgtactggttctggctacgatagttcgtgcccacaagtctaagtttgcttactgctactatggagcatactcactaggatgctttgtaatggcaggatggatagcttttgctatctactgtgtaaacaactaaccctcttaacggagggtttatttttttacatgtcatgtatactaatcctgctatttacttatgaggaaattcatatgccaactttaaaagtaggttttaacaaaaccaccaatgtcgcaactgtactggatgcgagtggttctatcccgggtggttcagtagaagtaggtacttttgtacacccggatgccacttacccagatagtttagttatttttcatggtgttcgtgatctgctgtataaacgttctgctaaagacccatctgaagaaggcttctggcctaacaacatcgtagatatgcagtccatctctattgatatgcaagctactccacgactgactattgctactaagctgcctcgtgtagtctccgctatcgaaggcgaagatattaactggcatgttgatgtagcaggcggtaaagcaccatttacttataaatggcagttcaaagctgatactgctggtgcagcattcactgatattagctctagtactaacccatctgctgctactgcaacattaacccttaatgacgtaaccgctgcttctgctggtacttataaagtgattgttactgatgccaatggaaccactgtagaagataagtctctactggctgttggctactacgaagcaagctcactggtagctactcctgcttcattgtctctgtctgttgctgctgatgctacttctggtaagactgtaaccattactaatgtgcctattggttcatctgctggtactttgtctattaagactgccccagagtctggtcgtgctacggctaccattgctggtaacgtattgacggttaaacctgtagctgctggtgaagctacttctgtagtagttaccaacggtaaggtcgatgtaaccatcgctattactgttgtagaataaaggtagcctttatttggggttgtaaaccctgatataaaactcccaagcttgacctcccagatgaagggaggtctttttttgacttaaacattctggagccaggaaatgtataaagagattgcatttttctcattcttactaggcggtttattaggtgcaggatttgtagctatttctaatacctactttggttctactccaaattctgtaacacaaaccctcaagcatgaatgtgaattgaatatccctcgtaatcaaaactgtgtaatgcagttcgtaccggagaaaaaatgaatatccacaatctacgtttggttgagaaactgtacgaagaatacaacgacaaccgacagcaattagctagtttgaagaagtcaccacatatggtgaaagtatcattcaatggtacggatttaggaccgcaagctcgtacaagaatacttcctgaactgctgtcattttatcaaaagagaattgctgtcttagaaaaacgctttgagcatttatgtgtagatttatcaccactcccagatgaaggagaagatgagtgaaattaacccagtcccaagcaatcttccttcgtatggttcaaggtggttctgccaccagcaaccgcaataataaaaccgcacagtctcttaagaaactgggcttagtgcagttcaatgctggtcttgggtggtcattaacccctactggagtacttcaactcaacgagttaaaaggtaactaaatgaaaactttaattgctgttgctgtagtagctttatcagttctgtcattcaatgctcaagcatccagccgtgaaactctgttagacgctgctgccgactacaaagccaataatgcaaactttgtgaaccagggttacttcatgggcatggttactatgggtgtagaggcaggaaataattgtgtaccggagaatatgaagttaggagccatatttgacagagtagcttctattatcctgtacgaccgaaaggttaatgcagtaaaagtgccatcagacatggttctgttagcaattgatacagcatacccatgtattaaatcttaattagtaattccattaactttaggagagtaagtaaatggcgagcattgactcactgaccgtatgtaatacacgtcaggcccgtaactttattatccgtgccctgcaagcaggtaacgtaccgttcctgacttcatcaccgggaatgggtaaatctgcaattattcgctctgttgcagaagaatttggtatgaaactgatagaccatcgtctgtctacttctgccccagaggatttgtctggtctaccattccgtaatggtgaccgtgcagagtttatcccattcgctgacttattccctattgagggggatgagataccggaaggatataatggttggctcctgttccttgatgagttcaactcagccagaaaagaagtagtagctgctgcatacaaactgattctagaccgtatgactggtcagaaaaaactccatcctaatgtgatgattatatgtgctggtaacaaagctactgaccgtgccattgttaacccactgggtactgcaatgcagtctcgcgtggttcactttgaaatggaacttaacttcgacatctttgttgaagacgtaatgattccacaagaatgggatgaacgtctggttgcattcttacatgctaacccaggttatctgcatgacttcgacccagcccataagaacaaaacgttctgttgcccacgcacctgggactttgttaacaaagacctcaagaaccgtcctgaaggtgctctgccagatgaagattctatctactatgcaggacacgttactgctggtaaggctacagaatttgttcagtttactcaggtatacaatcgtgtgattacgattgagaaagtagtcaaagacccgttaggctgtgcactaccagaagataacaacctgtgttgggctaccgttaatcatctggctaacaaaactactgaagagaacttcgatgatgttattcagtacattgaacgctttaaaacattcacccataagattctgtacttccgtacagtaggtagagcattaccagaacttcaggctacccctgaatggcgtaaggctgctgctaacatctctcgttacattcacggataatcacagcatgaaccggatacctcagcacacactcagtgatgaacaactcatgcgtgagtatgaccgtactcaggccaacgctttcctaggaagcagtgcagcgttctttggttcattactgtgtagtcttaaattctcatggaaacgtgaggattgtcccactgcatgtactgatgggatagagcttcgtttcaatccagacttctttatctggatgtgtccagatgcaagaaaaaccgtactaatgcacgagctatggcatgtggcatatttacatggcatccgacgtggaagccgtgacccagaaatctggaatcaggcatgtgaccacttcattaaccttcagttagaggaagacggttacaagttcactggtatcgacgaaggtatttgcaaagaccctcagtataaaggatgggtcgaagaagacatttatgatgacctgatgaagaaccctcagaaaaggcagaagccgtcagggggtgttggagcaggtcttgctggcgacatgaaatccccctcttcggggcagtcccagggtgctgttgtcaacaacgtagtacgtgcaatgcaaagtcagaagatggctggtggaacaatgcctggtaagggtgctggtcgtatggaagaggttattacccaattccttaagccagtggttccatggcaagaagttctgatgaacttctttaccgacattgatgatactcattatacgtgggccagacctaaccgtcgttacactgacatctatctaccttcactggaagatgatgaaggacgtttacgacacttggcctactttgaggatgtatctggttctattagtagtgctgactctctgcgatttaactcagaagttgcctacgttaagagccagttcaatcctaagaagatgtccttaattaccttcgacgatattatccaagaagaaatagacatcactgaagaagatacttttgaagagattaagattactggtcgtggtggtacaagccttgtgccagtacgcgagtggattattaagaataagccaaccgctgcaatcatattctccgatatgtatgttcgtccaatggaagaattaccatttgatattcctatcatctggtgtgttctgaataatcccaatgctaccgtaccttttggggaggtagttcatatccctaaaggaatgaaataatggttgttaatggtaattctctataccgttcatctcagttgctggatatcccagaccgtaaggtatcagagcatggtgtaagctatggattaggtgaagctggttatgatattcgtatcaaacaagatattaccttctatcgcttatttgggctgattccaatggtgaaagtcgttgatggaaatcaagtatcacgccatctcggtaagttcgccttggcctcagcaattgagaagttcaacatgtccccgtcctgtgtagcaatcgttcacgataagtctacatgggcaagacgtgcattatcagtgttcaataccgtaatagaaccaggatggaaagggtatcttaccctcgaactggtctatcacggtcgtaagaaattgcatatcccggctggtgctgggatagctcaagtattatttcatctggttcaggaacctgctaattacaatggcaagtatcagaaccaggaaaacaaaccagtagctgctagaccttcaaaataaaaggctatccggcttaattaaggaaaactcatgtctgtatttcaagtaacacaagaaaatactggtattcgcctgacccttaatgcgaaccaagtaattgcagtgcaagaacttaccgcaggtaactctgctattactaccgtaggtggtgatgtagtaattaccaaagaaacctatcgttcagtacgtaattacctgaagaaagctcttgctcctgcaagcaaagatgctgagtaagtagctgcttaaatagcccagcatagttgggctatttgtgaagaaactaactcaaccccacataggaaccatcatggaatctttagcagcaatccttgttctgttatttgtattagctgtataccttatccctactatcattgcttttgcacgaggccatgcctccaagtggggcattggtgtactcaatattgtattaggctggtctttagtcttctgggtagtagcactgatttggtcactgtccaacaaaggtcagaaccaagttacaaacgtaactgttgttcaaaccaatggtggcagtaaatcagagtaactaacctaagcatcattacatagtgatgcttgtggaagttacttccagctcattgcttatccatctcctaacccaagcccacctaacccgtgggcttttttatttacaggtactcttatgtcaagcagacaaaatggtaagtctatcctgcaagggctggacttaagtaagctggaacaaactgcaatgcttactctaggtaaaactatccatgatcaagtagagaatgaaattgagttagatctttacacgacaatgcaggctcttgttcaaaaaggatggactattagcagaccttttccttcatacattcctccggaacctcatctgaaatctaaggtagaccgaatcatagataagttctggcttagcccatgtagggatgatacgtatctttacctggctcaaatacaaaagaatcctcgtactaaggatgtgttcaaaggcaagagcactacccatcattacccttggtatagaagaggtagtaaatactaatgcgtatcccattcctacggaaaagggaacgaaatcctgttctttacaataaaggcatagaggatgagtatgaactcaaccgtaaagctcgttcctacacaacaaaattattcatggggactaacaatcctgatagattactggactttgtttttgaacaaatctttatcatatacagcttagctatgtctgctggttcacaagaagtaagtgataaggcaagagatgctctctgtatgctccgcagggagtatgaagccctcatgtatgaagacttatactcctttaaaaaagaaaccgctgtagcgtgttctgtggcccttactgaaggtgtagcagtattacaagaactaccccgtagtgagtttaagctggtatatgttcaggttaagaaaattacagaaaaccgtagtggtatcaccaactatctaaggtcattctaatgattaaggcaactgtcattgcagattccgttcacccagaaacaggaactcgtattactacctttgaattggtttatccccgattcattcacagtgagtttatgacccaccgtgtattcaaccgtaatgcctcaagcagtcgtgctattcccacggctaagttcatcgaacaagttcgtaatgaaccagtgatgcctagtcactggggcaagaaccagaaaggtatgcaagcagaagaagaactcactcctatggagattgaggatgctaagtttatctgggataacgctgcatctgctgctgctgtgtatgcagaacagctacgacgtgggcaagtacataagcagattgttaaccgtattctggaaccattcacgcatattcgtgtagtggtaacttcaaccagctgggctaatttctatggactgcgtgaccacaaagatgcgcaaccagagattcgtgaactggctcaagcaatgcgtaaggcacaggaagaaagtacaccgagagcattaccatatgggcaatggcatctgccatatattgctcatattgaccgtgttggggcttacaatttctgcaaacgcaatcgagttacacgcgatgaaccaagtgatgcagaagtgcatggactacttctcaaagtaagtgctgcacgctgtgctcgtgcttcctataacaacttcgaaggacgaccatctactatcgaggaagaccttggcttattcgctaagttagtagaaaaccagcctattcatgcttcacctactgaacatcaagctacacctatgaaccttggtgaaaagtatgtgaataacatgaacccagttacatgggaacaaggtgttacatccatggataaagaaggaaatctgtactcaggtaacctgcttcactttatccaattccgtaagttaattcctggtgagactattactgaatgaaaaaactagctttgtacgcaatgctaattagtaccctattaacacttaactacgcatacaaagttgcctttgtcgtagaaacagatatgcagttcattcgagctagtattctgttctttgtgagtgagtttggattatggtgtgtttactactttgctcatgactatgaagctattcgtgagcaagaggaagtaaagaaacgcatgagacgtttcattgaaggaaaatagtaagtaaacctaagacctcctcctggaggtctttttttgattctattaactcttttaggagggcgtatgcctgctaaataccgtatcaaagacacaccagtaatgtgtgagggtgagaagggtgacattgtatatgcctgtatacaggatgacttcaatgctgctctgatgttaactcaaatgacaaatacactgcatgtatcagtaacactggaccctaccggtgactatccatgctttcccatccctgctcataacctggagcaaattcatgattaatcctgaagttattcatagcaaaactggaaaagctgttccactcagtgagattgcagttacaggtgatattgctgcttgcccagctaacatcgcttccttatgtatgtgcattgctgcactggcagaagaacgtaagttatggctggaaccaagcaaggaaatgatactggctggtatgtctgaactaaatgcacttctgaaagaaatgtatgacgaggatgggcaactagttgaaccaactgatgaccaaatctcggatgctgttgtattcacccttcaagcaatggcaagtaaacgttaattaaatttaagaagcaacacttaaactggagagtaaataaatgttagttgcagataccaatgaagtagctacctcagcgacactgggtggcaaagaaactattgcctttggcatttccgatgacccggcattcttccatgtattaagtacttccttgtataacaatcctactctggcagtagtccgtgagactatctgtaatagttgggatgctcatattgaagcaggtaagactgatactcctattcgtatcactattgatacagacaattttattacattccgtgactttggtaatggtatccctgatgaactcattggttccatttatggtgtctatggtgcatctactaagaaatccaacagtagtgttactggtggttttggtttgggatgtaagtccccattcgcttatacagatagcttccaggttacttcatggaaccgtgggaagatgtcagtatataacgtagctaaggctgcgattgagaatgacggtaagcctggcattgttcctattgttactggtattcccactgaggaatcaggtctggaagttaaattccagttaggtaagcatgacgtaaatacctttgtgcattacattatatctattgtatttaacggtgagattaaagctgaacttagtatccctaaacttgttaaaacagaagaaggtaatagtattcagcaaggtgactacactctactgaatacattaggtatgtcatttgaacctggttcatatgatatgtctgatagctggtataagggttatatgggtaacagtaacatattcgttcgttacggtaacgtaatgtacccaattgtatccagcccagctagtgaagaggctgtgggtcttatcctcaactttatgaacattattggtgctgctaatttagtagttcaggctgcaccggatactctagctattgctcctagccgagaaacactgtctaaccaaaagttaaccgacgatggtattactactctatgcgtagatttagtagaccgtatggagaaggagattaaggctaaaattcctgaagctattaagcagattgaagaatacgcctctaaatcatctacccgttattgggaatattcatctttcttacttgcagttacagacagaactgttcaacgctatatgtcctctagcttgtgggctaaacaacgtaaacatcacatcaaacattggcgtaacttatccaataaagcattattagctcgccctgaatatgcgggtcttaagaagctgtatagtaaggctatgagtgctcttaaagatactcgtgcggatggtacaagctacccattccaggaattagtataccggcatctacatttacctcagcttgctgctttaaaagaaactggtattaagtggtctggttacatagtgaaccaaggtaaccgtgttgatctggtgagaggtaaacttactgattactttaagatgggctataactgccatttgggtattggtattttcactaccaagaacgttgtagttactcgacgtttatctgattgtgcggactctttctcatacttccctgaatacaaccgtggagacttagagcgtacagcttttgttcacgtcgttggtcctaagaaaggtgcagcagaagaagctgtagctaagttcactgctatgggttatcgggtaattgacctcactcaatataatgagtgggacaaaccaactaactaccgcagagaacaagctaagatagctgctgagaaacgagctaagacgatagctgccaataaaaccaaagcagggggtaaaactaatgctctgatttcgttgaatgcagttctcggtactactcctgtacgaaataaaagtggggattgggattctaagccgtacattgacaaggattttactgacccaagcttccatgagaagtacggtttcactgaagtggaacaacctaagtactacgtgttagccaatcaggttagttctggtagtccagtaactgcccggattggaaccatgtggaaatggtatgagttatccgatgagatgaaagcagagactgttgtctgccgtaatcaaatcgaagctaacaaggctaaacgacgtggtgctatccacattgacgatgttcgttttaaggaactgatgcctgtcattaccagcaagggatttaagaagtatgtcactgaacaccgtattggtattctggaatacgtaggactggatgacagagagtattgggaaatcctagatattcttggtctaacgttcaaaccattacagaatctgatttttaaaccagagtatgaatgggcttatgatttcttaagaaatcgaccacataacaacaaagaaaaacttgttgaaatgggttgtattaagtcagttgatgacttagagccatatacaatgatggttaatccgcgtaatcataagtactttgaaatacttaatcagtacaaggggttattcagctatagctggagtgctggtgacatactacagagtctggacttggggagtttagttaaacacctcaagaaaaatccagaggatattcctgggtttaagtccctctaccgtaatcgtctaaataaactgaaaggtaactaatctgatgaaaatcgaactgatttctatcatcgcactggcagttgacagtcgaaacttaacattgtggaagcctgatggctccacaattgtatatccacagagcgacccacgggttgctcgtatcgtatctgaagcacaaaccaaaggcttgggaattaccaaagacctgatagaagtaaacattgcaccagaagtatcactgcgtaatgagtatctggaagcagagaagaacactaatggattcgtccgtttcttcaaggtagctaaagctaaactcaaagagttcttccaggatggtacagatgttcaacctacccaagccgtttctgatattaagctaggcaatcccaccaagacattagtatctaaagctatggatacattcctggctgtacaagctaatgaaccagaagtaacagtatcagatggttgctacgacagacgtgacaatctgatgtggattactggctgggataaggaccataactatcctgcactggttcgttttattaacgacgtaatgggttgggggtatgaacaaaccaacaccatgctcagacaggaatggcctgttgcagttcgtgcagtatccgatgatgaaatgggtgagtttgctaaacaagccaagcacatcaaaggtgtacatattgtatttaccagccgtaaacataccccaccaccttacattgaagtagctaaaactacgaaccaggataagctggctgctgcatccgagaaattagctgcattaggtgctattagtactgataacgctaactttcacactgatgtgaaggaagatgaagtggttgttgctgttaccaacgatggggttatccctggagttgagaacctgcaacgtcacttacgtcagtctgccaagttgaaagactacaagggcttcactaagttccttgagcgtctggctccggttattaaagaccgtctgcactcagtagaagacctgatgaagttcatggaaactgctgaattgcctatcgctgatgatggttcaatcctgttccttaaacgccttcagtataaagggaaagaagatggtaaacgtgtattcgttgactgtcactcaggtaacatcaaacagtgggtaggctgtaaagtgcaggtacgggaagacctggtagatcctgaccgtcgtcaggactgttctaacggtctgcatgtagcatccatgagctacattcgtagcttcggtggtaacgtaactgtccttggtaaagtagcaccagaagatgtgtttgctgttcctcagtacagcactaataagatgcgtgtatctgcgtatcacattattgctgaactacccgaagaggaacgttgcaatgttaacagtggtatctatttgtctaaaactgaagtaggtaagaaactacttaatgatgccatcgttgggaaccatagttcacctaccacacttattatggttggtgggcatcgtggtactaacctcaaatacactaatctcacatctggttctgtagagcaattccgtacagttgctagtaaagaggcactgaatatggaagagtcactgaatgaagctgtagcttctgaaccagtgaaagctactgaccttaaacccgttattaagaaggctcctactgtgaaagaacaaatccaggaactggttaaagagttccttaatgcaacaacaccagaagataagttagctgctgctgaccttctggtagaactgcgttccaaagctcgtaagccttgggctgcatttgatgtaggtagtgacgtggtagctaagattgctgatgtacgtgctacctatacaactaagcctattggtaaacctaaagctgttaagcaggatatgacagttaaacctacccgttctgctgctgccactaaagtagctccttctggtaaacacgttgataatctgcgtagcatcctgaacgatacgtcatattctgactatcagaaaggccatgctctgcaagactataaacgtcatgctaagaagtcattcactgcaatgggtctgactgaagaagaagctaaattagctaccaagctggttaaagcagttaagtaatagcctgttcaaatgccctcacttgtaataaagtgagggtaattttgaggaggaattgtactatgagtaaagtattcagaagtaatcgcaaagcaactgatgaagacatcattcgtatgaatgctgttgggctgtccctcgcaactatcgctaagacgttgggggttcaccccactacggttactttgcgattgcgttctttaaacattgaaccagccgacacacgtcggacgttcatggaaaacgtattacgtcctttaccaacccatgtggctgattggctatcagaacaagttggtcctgcttatgaaattcgttcatatgtaagggacttgattctggaggcatataataatcgccaccttaaccaagagagtgagcatgacaagttcatccgtttgtacgctggcaaatacggaagcctggttccggaaagcagtaccaaatccgacgagtaagaatattagtacccagattggttgtcatctggaagaagtagtagagatgctagacgagttatacgctaactcagaagatgcttacgatattcttcacaatgccattgcagcattaaccgaattgtctgatttaatgaaaaaagatgacaaagaggtatatgcaccgaacagccatcgtttagctatccttgatagtcttgctgaccagattgttacagcaaccggcgtcggtactttccttgggatgaatgtccctggagcattggctgaggttaatcgctctaactattctaagtttgaagatggggaacctgtcttcaatgagaacaagaaagtcatgaaggggaaagactacactcccccagatttgtccagtttcatttaacgaaagccccaaatggggctttctttctatggagtcatatatgaattggcacgctttatttgaatacatagatggaaagctctattggaaagttaatccatctatggcagtgcgtataggacacgaagcagggtccataaatggagatggttacattcaagtaggttacaaaggccatgtttatcaagcacacatagttgtgtgggaaatgcacaacggcccggttccaccaggaatggtcatagaccatgacgacaggaacagaaccaataatcgaatagataatttgaacttagttactcaattacaaaacaatagaaacaagaccaaaagtaaaagaaacacatctggtgttactggagtgtactggcacaagcgtgaccagagatgggtagcatcaatcaggatagaaggtaagctgaaacagttgggtcagactacctgtctggaggaagctattaaattaagaagggaagctgaaataaaacatggcttccataaaaaccacggtaaataactggagatttaaatgttttccaaacctaccaaagccccactgaaccaggggcaagaagcggttgcgaaggagttcttcgacttcctgctcgaccctaatgctaccgaattcaatattagtggcccagggggaactggtaagacattcctgatgtcgcacctcattgatgacactatgcctgcatacatggaaacttgttctttgatgggaaccaagcccctgtataacgaagttgtcatgactgcaaccacgaacaaagctgctgaagtactggctcaagctacaggacgtccaacatctacctatcactccttccagggtctgattgttaaaaatgactttaagactggtgaggctaatgtcgtaccatctaaatcattcaatattaagaagaacaaaatcatcttcgtagacgaagcatccatgattgatcgtcagttacttaagtatgctcgtgaaggtactcaccagtgcaaactggtatttgtaggtgatgcttctcagcttttacctgttaaagagaataagtctccagtgtatgcaggtaatatcccaacacactatctgactgaacagatgcgtactgatgcaccggaacttaaagcattgcaccagcaattgcgtgatacggtggaaggtaagacaggcttcctgccaattaaatgtatcccaggtatcattgactgggtacaggaggaagagatggagaaattggttctcagtcacttcactcaacctaccaacagccgtattgttgcttacacaaatgaccaggttattaattacaataactacattcgtgaagctaacggttatgtgggtgaatactccatcggcgagcagctggtatctaactctgctgttcgcttgggtgtggataatcgtttatctattgaacaggacgtaaaactcattgaccaggatagtagtactcgcatgattaaggttacaggtgacctggaactggaagttcgtgatagtactcttgacctaggctatggtggcattgtaagtgaagttccaatacctactgacccagactacttcaaccgtttagttaagtggttaggtaaagaaaagaactgggaaccttacttccgtcttaaagaaaccattccagacctacgtgctactcatgcgtgtactgtccataaatcacaaggctctacttacgacacaatctttattgatgcaaatgacctctcaagctgtcgccaaccggatatggttgctcgtctgctttacgtcgctgtgtctcgtgctcgtaagcgtgtagtgttctatggcaatcttgccagtaagtacggtggcctaactttctaagggaggatatatgcctcagattggttcagcgactattggtcaagttgccaatagcagcgagatagtcaagcatctgttcttagcagaactggttcgtcttgatggtgtgttaaacggtatcattgataagaatgatcgtatcaatggtgtagatgtatcagctggattcctttaccagggtgagttctatcagcgttctaacgctaccagacctccaacctacggtgagcgattaacgcttaatccagaactgtggcctgcaatggacaagtatctgaaagcctccagtcgtttgattatggaagtacaccttgtgaaccagactgtatatcgtctggttcgcggttgtatgtcctatcaggatgtacgtgatgctctgcctgagtgtctggtagcacaagaccagacgggtcagtacaaaggtctgcctcgtactcgtgaagcagcctggacacttgctggtgatgctatggcaatcaagcagtatgagaagattctgccctctattgagtattatgcagcttcccatctgattttctaaggtaaagctatgcgttacatcacctctcaagatactggtaagtatcctattgctatcctcggtcatcaaatccgaagggaggagatgattaaaacctacctgctgccttatgacctaagcatggaagacttcatctttattgaacttcattctgcccctggcaagaagaagactcctgcaagggagattaaggagttcatacagcaggaattacagcaagtactggatgatgcagaaactcaatatattatctgtactgattctgactacttcaaaatactgactaaagaggctaaagcagaggctaacctcggctatgtttgtgattcagtatggggtaagcagaaggttatctatacgcctagctacaggcaagtcttttatgacccacctgtagtgagagccaagattgctcagggtatggatgcattgcttaaccacattcgtgggcagtatgctgaaccaggccagggaatcattgagtttgaagcatatccggatactccagaaaagattaaagcctggctagaccagttgcttgagatgaataagccattggctatagacatcgaagcattcggtttaaagcactataacgctggtataggaacaattacattctgttggagtaagacgcaaggcatagcctttaatgtggactacgagccaattcctggggctacagaagcaccatatgggcgtatcaacagaaatgatattgttcgaaaccttctgcgtgagttcttcattaagtacacccaacggcagatgtatcacaacattagctatgacgtgtacatacttatctatcagctgttcatggataacctgattgatacggaaggcttactgcacggcatggagatcatgctacgcaattgggactgtactaagttaattacctacttggctactaacagttgtgctggtaatcaccttagtctgaaagaccaggctcaggaatatgctggtaactatgctcaggatgatattaaagacatacgtcttatacccaatgagcaattgctacgctacaacctcattgatggattgtgtacttggtacacttatgagaagcactgggatactctcattgccgatgaccaactagatgtttacaacaacatctttaaaccagcctgtgaagacattattcagatgcagttaaccggtatgcccatgaatatggaaaccgttaaccaagtagctgaagaaatggaaactgacaggaaccaggctctgaaaactattcgtgagtctaacctcatgaagaactttaccctgatgcttcgtcaggaatgggtagacgataagaatgctaagttgaaaaagaaacaggtaacactggctgattgtaacatcgagtttaatcctaactctagtccacaactacagaagttgttatttgattatatcggcttaccggttcttggtcttactaagagcaagcaacctgctactgacggtgacactattaaagcactgcgtacacatacgcagagtgaagatgttaaggaactgctcaatgcacttatcgactataagcttgtggataagattatcactagctttataccagctttcaggaatgcccaaccgggaccagatggctggcactacctgttcggtaacctcaatctgggaggcacagtctccggtaggttatcggcttcagagccaaatctacaaacaactccatccggctctaaatatgccaagaagattaagaaatgcttcgaagctcctccaggctggatattttgcggcttggatttcgcctcgctggaagacagaatctctgcactgacgactaaagacccacagaagcttaaggtatataccgatggttatgacggtcatagtcttcgcgcatatgcttattttggtgagcagatgccagacattgaagacacagtagaatccattaactccattcagcataagtacaaatcattgcgtagtgactcgaaggctccaaccttcttacttacctatggtggtacttatatgggcttaatgaaaaactgtggcttctccgaagagaaggctaagactacagagaaacgttatcacgatctctatgtagttagtgatatgtgggttcaggctaagctagatgaagctgctaagactggttatgtaactgctgcatttggtttgagagtgcgtactcctttactggctcaggtattacgtgggacatgtaagactccatatgaagcagaagcagaaggcagaactgctggtaacgcattaggtcaaagctggtgtctactgaataaccgtgctggctcagagtttatgcgtaaagtcagaaccagtgagttcaggttagatatacgcccttgtattcacattcatgatgcccaatacttcatgattcgcgataacatggacaccttgcagtatacgaacaagcacttggttgaagccgttaactggcaggatcatcctgatattgctcatccagaagttggtttgggtggggaactatccttgttttacccaacgtgggctaatgagattgaaattccaaatcacgctaccccagaagaagttcatcaaataattcaaaaggcattcgcatgaccaaaagtactaaagaaactgtagtcaaaaagtatcattggatggtggcagcacaggtaatcttccagcttcctaaagctgatgatggctccctgcttaccatgaacacaatgctgctcactgacgaacctcatgtgacctataaagatttggctcgtgccaatcactcactgaagattagtctggatcagcgtttcgatacctcagttgatttgaaagatattgtttatctatctattaacaacctgggcctgatgtctgaaccagagttccaggcaaacatgattcccaagggggaataatgactaagctctccggtggtcttaataactactatgtagttacaattaagaatccccaacggaaagagcaagagccataccaagcagagtgtgaggatattatccaagcactaggcatgaccttcgatgaaggttgtgcctttaaagctctatggcgaaatgctgctgcccgtatgggtaatggtaaacctggaaacacttcagtttatgactgtgagaaattggttcattacgctaatcgtattcttactaaagagaagttagtagatgaattacctgccacagatatcactgctactgggagatgctggcattacccggggaatggaaagccttatctaacagtgaactttcagttcattgaggtagcgtacaaaggtgaactagataacatagtcagctatagcttcgatgaggtagagagtattcgttggaaccaggtgcatagatacaggattacttactgatgaagataaccaacaaccatgatgtctcgctggccctggctgtatggctattacatgacgagtatgattatgtagacaatcctaagtatctgtctgtaaccacactgcttaagccacttaagcaaatcgtcatgaagcatcgtgtagacctcagtgaccagtcaattgatgttatggattttgtctccacatcaatgggtactggcttacacgattctattgagaaagcctggaagttaggccataagactgcattgaaaaagttgggttatcctcagcgagtaattgatgcagtagtcattaacccaaccaaagcagactttgatgctaaccctgaccttatcccaatctacattgaacaacgtggaaccagggtagttaagggttggactatcggaggtaagttcgacatcgtaacagaaggtctattgcaagactttaagtctacctcaacctattcctgggttgctggttcccgtgatgatgaacacaagatgcaaggtagcttgtaccgttggattcacaacgacatcattaccgaggatgtaatccgtattaactacatcttcactgacttcatgaaacacatggctaatagcaatccgaactatcctgctaatcgtattatgcataaggatattccgttgttatctgtcgataagactgaacgttgggtagaagagaagatacatctcattgaaaagtactgggatgctcctgaagaggaaattcctgaatgtactgatgaagagttgtggcgaacagagccacaattcaaatacttctctgatgcttctaaggtagatatgcctggagccagaagtaccaaaaactttgacgatatggcatctgctcgtatcttcatggctgaaaaaggtggcaagggtgctatcaaggtcgtggaggggcaggttaagcgttgtttatactgccctgtcgcatccatttgcaaacaaagagagagatattttccatcatgagtattgaccttaccggagtagtgcatcatcaggcgattgaagaaatcgtagatgtgctctgcaataaaacccagaacaatgaccggggattcttccgtgtcgaagtagcctacttcttggctaaaatggcatcctgcatgggtgcaaccatcgtaactaaagaccgtggtgacctgccggtaaacatctacgctatagcgttggctacatctggtttcggtaaaggtcactcagtaaatatcatcgaagacgggttcatgtctggcttccgtaaacgctttatggaagacaccatgcccgtcatcgcaaatgatcgtctatggaagattgctaacgaacgttctgctcgtcagggtactgaccagcaggaagagtttgataaagttgaggcagagtataaacgtgcgggagcatatccatttacgtttgactcaggtactccaccagcagttaaacaactacgccataagctgttaatggctgggtgtggttcaatcaatcttcagattgatgaaattggttcaaatctgttggctaacatggatgtactaaccctgttcctggagttatatgaccaggggaaagtaaaacagaagctaaccaagaatactgctgaaagcgttcgtggtgaagaattggatggcaaaactccaactaacctgctgctatttggtacaccaagtaagctactggatggtggtcagactgaagaccagttctatggctttctagatataggatatgcacgtcgctgtctgtttgccactggtcacttagacaagagagcacatgcaacattaaccccggaagaaatctaccgtaacctgattaaacaagataacgtacagactcttggtaagtgggctaaccatttccatagtctggctgacccaaacctatttggttttaagatggttgtagaagataccgtgggtattgctctgattgcttacaaaattgattgtgagaagcaagcagaagctatggctgaccatgaagatattcgtaaagctgaaatttctcaccgttatttcaaagcacttaagctggcaggtgcactggcgtttgttgaccaaagttcattcattgagatgacccaccttaaacaagcaattctgcttgtagaagaatctggagcagcatttcagacaatcctcaatcgtgagaaggcttatgtgaagctggctaagtacattgcttctgtaggtaaagaagtaacccatgctgatttggtggagtctttgccattctataagagtggtaatgcagctcgtaatgagatgatgactcttgctacagcatggggttacaagcagcacatcatcattaagaagaccttcaatgaaggtattgagttcttccgtggtgaaactcttaaagagacagacatcaatgagatgattgtggcgtatagtgatagctttgcttatgactacattggtgaacgtgtaccgttcgaccagttgcatgtattaacccaagctcccggtatgcactgggtaaaccatcacatgaagaatgggcatcgttctgaagaaaatgttatcccaggatttaacatgattgttattgactgtgatggtggagtacccctgcatacgtgccatgaactaatgaaggaatataagttcatgacctataccaccaagcgtcatactgatgaagagaaccgcttccgtctgattattccaatgaactatgagttacacctcgacactgaggaatacaaagagttcatgaataacgttatggcttggctaccatttgaaacagatgagtctgctaaccaacgagccaagaagtggatgtcctgtgagactggttcctatcattacaatcttgatgcgaatctgttagatgtgcgtgactttattcctcgtactagtaagaacgagcagttccagaaccagatgaaggaagtacagtcgttggataatctggagcgttggttcgctagtcgtattgcctccggtaatcgtaataatcaaatgattaagtacgcactggcattggttgacagtggttgggacttttctcaagtacagcaagccgtccacacattcaataagaaactggctaatccattaccagatgatgaattgaatgcaaccgtaatggtcaccgtggctaaacgctacgctggcaaataagtaaacaggagtctttctttggtttgaaggactcctaaattaaacgaggaaaaataatgtccgaagaaatctccaatgatatgaacactcagctaatcctgattgcaggattctcagcgagtggtaaatcagcatcactgcgtaacatcaggaaccaggaacgctggctctatctgaatactgaagcaggtaaacgtctacctttccgtaacaagtttaatacctacaacattgaagacccatatcagatttgggaagcatttgatgttgcatccccaggtggtgaaatggcagacgatgttgatggaatcattatcgactctgctaccttcatgatggatatgctggaatctcagtatgtactgccatctgctaatactcagaaggcatggggagattttgcacagttctttaaaatactgctgcaacagaaagttgttaaatttggtaagccagtaattattactgcccatgccaaagatgaactcgacgaagctgctggtgtgattaaaacattcatcccagtgaaaggttctctgaagaacaatggtcttgaggcttacttctctacagtggtttacgcagagcgtgtagacattaaagagctggagaagtatggcaacaagatgcttgaaattaccgaagaagaacgtgacttaggttataagcacgtattccagactcgcccaaccaagaagtctgttggtaaacgtctacgttccccaatgggtatgttcgataagtctgagacttacattgataatgatgcccagaaactcttagaccatctggctgaatactacgcttaagcgtttgcctggttgttaatcacttattaggaaaaatattatgtcactgttcagtaacttgaaagaaaaaaccaaaaacgttgaagctgtaaaagactcccttggtggtggtggcttcggtgcaaaggagtcagatatctacaccggtactgtaaaagtagcttacgtaggtaaagctgactctggtgcagactggatgcagttaatcattgaaaacctgaaaggttctgatggtaatgatgctggcgagttccgttcacaggtgtacttcacttctggtaattctaaaggcaataagcctacttacgagaagaacggtaaagaatacttcctgccgggatacaccgtcattaacgacatgatgctgatggctaccggtacggaactgcctgaagctgacttcgaagagaagattgttaaagtctatgacttcgatgctaaagcagaagttaataaatctgtcatggttccagtagacctggttggtcagactgttaccttcgccctggaaaaggttctggaatctaagcaggttaagggtgacaacggttacgttgattccggtgaaacccgtgaagtaaacgagattcagaaagtgtttcacccggaactgctggtcacagtcgtcgaggctcaggaagcagagaaggctgagaaagaactgaccccagaactggctgtattttatgcagcatggttagaaaagaacaagggtaaaacccgtgataagaccaagggttctgctggtggtaatggcaaaggtggcttgcctcctaaaccaagtgctggcacgggtactgctcctgctggtggtaaatcactgttcggtaaacgttaatgaaaatcccaattgttggtgcagacattagtctccgcaattggggtttagctcgtgggatgctggacattgagtccggcgtcttcgagcaggtcgaacttaaactggttcaaactgaagttgaccacaacaaacaagttcgaaccaactccaaagatatacaagccgctcacgatttgtttcttggttgtgaagaatggttacggtctgctaaagcagtattcgtagaagtaccagtaggctctcagtctgctaacggtatgaaatcctatggcgtatgcgtaggattaattggtgcatttcgtgcattgggttgtccaatctttgaagtatccccaattgaaaataaacttgcactggtcggtgataaaactgcatccaaagacacgatgattcgtgctgcccatgctatctatccagaagccaactggctcacagataaaaaaggtaaacttctgaataagaatgagcacttagcagatgcaatcggtgcaatccacgctggtgtaaatctcccagctttccaaaaccttcttaatttaataaaggcgtaatatgcaaatcattttgaaccagtccgaagtagaagctgctgtacaggcttatgtcgatgatcaaatcaatcttgctggagacattagtattgtcatcaatgcagatggtacagcctccgttggtattaacgaagaggtaagtcataacgatgatactccacccttggtagagaagaagacacgtcgttctcgtaagaaccctcaggaagctaaacaccgtccggtagaaccggaaccagaagaagtggttgaagaggtaaagggagaagaaacccagacctctactggtggtccgaacaagagttctacgccggaacctgaagaagaagcagtaactgaaccagaagcacaagaagaagttgtgcaggaagaggttaaggctgaagaaccagcagagaaacctgctactaagccttcactgttcgctggccttaaacgtagttaatctggtaggtggctcagaagctgctgctaggtgtggtagtgtttatagtcctgatgctactactggtcaggattatagacgtgtcggctccatacatagcttttatcatcactgtcattatcctgtggaaatgcagtggtaaacacggtggtgacaagccgccagagtaacaacaaccgaaccagtcccctttaatactctccgaaggggattggttcaaacagggttaacatgaacaaatttactattcactggctcaatggaaaggttagttctttcatgggtggagaacctgctgaaggaaaaaaaagcattccacattgactcagaaggctgcaaaatcttaataccgtatgcttggtataaagatggtgaagtagaagcattgaagaagagcagttaatatcgtgaagggttctgttagaatcctttgagataggaactcctatcataacctttcttaacttaatctttgccgtatggcactgacgctaggggtggccccccatccgtcagacagactattttaagaatcggttatcacagaaaatgtaaagcaacattcgggttaatcaatggcctcttcctataggggccatttctgaatcttaggctatatcccaaaggttagtatctttaggataaggcttcagatcccttatcaaactaaccgctcaatgttgagcattctaatcacataagcccctatatgggctgggttaaatgtcggatagcctagctacctacaacatcgaactgttagatcttacatgcaatatagggtataaagggaggattcgtcccctcccccctattatgggctatcggtgagtgcattagttgattagctgtggaaggtaggccgatgtccacaagcgtggcccagagctagtgtactctccgatagttttcgtaagcgattatgcggttttttagaaacgaaccaataacataagtgcaaacgaagaagcgtatctgatggcagcttaataagccaagcgtcagtcaggagtgagtcgtcctgattatcaaacgaccgtggagttctcccgtccatgtattagaaacgggggactaattatcagttgcacgagatggcttgacatgttcaagtttggactaagtgtgacaccgctagattggagggctgctgcggtaagctatagactccaaccggaggttcgaatccttcactgataaccaattcaaagtagcattgtatatttaaatgtttcccggcatttaaagcacccaccgtgacagtgctactctaaattggaagaattatgggggtaagtcgtaaccatacgacggcgtaagtaccagatgagacttctggacgcccctaccatatttgaggtgtaacagttaaatccagttgccggaagtgcaattctagatacgctgccaatgtgtgaacggtaaggctgtacaggactcggactcccacctcaaaccaaagtcgccaggtacttatggcaaacgggtagtaacgaactagtcattcgtcaaacgcccaacccaattatgagtcagcaagaacgccttcacttaaatttaaacaaaaaagcttaacgcaataattatgtaggggtatgtaaggattgcgaagaaggagccagttagagtctggcatgactcacctattaatacccggtaggcttagtggtaaagccccactagtaaaccaactaggacgcaggttcgaatcctgtccgggtaaccatattatgtccgcttagcttagactgggaaagcaaccgactaataatcggaaagtcactggttcaaatccagtagtggacacccatttagcagtaacatagtcctgattgcatcgcactctaaagacaacactggtaagacagtccagtggctgctattgtattgttattcccttcgacgggaatttcgctggagaatgggaactccttaaatcctagcctgagtaattaccacaggaacgggactatcaatcccaagcctggtcagcgtggactgtcttcgtggtaagaaccaaaagcctcccagctatgggtaaatagtactaagtcccctggagccgtcactctgggggacttttttatttgagtattaataattggataatcaatatgattgacctaatctcaaccccgtatgcctatgaggtaacggataatcgaggacgcaagtctttggtgtttgcaggtagcgtagcctataacaacgcagtcatgtttaagtacaaactcaaaccactctatgaggctaataatggcaacagtaagtaaagaagcaatcgaagctaagattaagagcgtctactattttaatggagctgatgcagtgaagtctgcatttgttgatccatctgcactcccggcagatgatttggctaacctgggtctgataacctattgcattatcatcttggaaaatggcttcaaagttgaaggtgtatctgcctgtgttgacccagctatctatgatgagcaaaaaggccgtcagtatgcatatgaaaatgcattcaataagatttgggaattagaaggttacctgctacgtcaggcactgcatgagaaagaagagactgctaaagctctggcttcctttgcagaaaacaacacctgtgatggtggtggttgtacaatctgattcaaaagtgtaaggtagtttttaccgaaaggtactgaactacccgacatgtggtaaggctcatgaagccaaaacaaaacaagccctcctagtgagggctttctcatttgaggtagttatgtcagaagaaattaaagtccattttaccaattatatcggaaccaagtgtgtaaatggtttccgaatgaacaaagaaacatactgcaaacttcgtggctgggatgtacctgctaatgaagacccattagaagaaggttacttagtagagtacccagactctaagtctaaccatcctcagttccgtggctatattagctggtcacctaaatctgcatttgaaactgcgtaccatgacgtagaaaaaggttgcacctttggtcatgcagtagagcttctcaaatccggcttcaaactagcacgtaaaggctggaatggtaaaggaatgtacattgagtacgttgctgctcaagaatggaatagcagtagcttagagcgtacaggacttgctgatgaattgaaacctcgtccatggttaggaatcaaaactgttgatgaccagtttatgccttgggtcccatcccaatcagatatattagctgaagactgggtgttagtttagtaaaaattaaagcccctctaatgaggggctttttcatttagttagctagattgagccaagggttaaggttatgggcacgaagtccctgaccgaagccccaggagtaaccgagattgccttgtgcagcaatactgaagatgttgtcctgaataggtaaaccaacattaccaaacatggtaggagttggagccaacatagccatagctgcgtgtaccgggttgttacgaatcatggatactgcaatttttgcagaacgaatcttaaagttatagaaccacataagaccaacactttccatatacccacggaagcgaccaggcagacggtcatagttaatgaactcttccgttacacgtccaagtgcttcttcacgagtcttacctttacgctgagtcaaatcatcatagatgattgctttagcaataaagtcagagtactcaaccgtcttctggataccctggaataaagcagtatccttggtgataagggcataacgtccagcattacgtacagacttaggtaacttatcagccagtttatccatgtattcgtgaagtttaccttcagtaatcaggatgtcatctcgtccaataccagcatctgcaattgaagaaaactcaccagcttctaacagaggccagatactcatacgcttatgactatcagtgatggactgaatttcagccttaagcttacgaatctggttcgggttagtagctgcacgtaactctgcttctgcatctacctgacgcagacgagatttcaggtactggttaatctcagcagtcttctgtggaatgctcttagcaatgttcttaacaggtacaccacgaccaaccatctggtaaaggttagccaggaagttaacagcaggaacaactactgatttaactacaatcagagtcttagcttctttaactaagttttgaaccaggttctcaccacccattacatacttataagcacggttgccgaatacacccaacatagctttcttgaaggtatccagtgtttctggtgaccaacgagaattgccagaccaggcatcacctacggaagctgcacgatagcccagtgcatcattcagcatgtcacgacgtacccacaactcaccaggaccaaacagactttctgctttctgacgagtttcactgttcatcagcttaagggcatcagcagttactgggtccagtttagaaccaagaaggttaacgtactgtgacttgttagaggcagacattttaatgtcgttttcatacatgctatgcaggttctcaatcagcatatcattgaaacgctgagccttagcttcctctacctgacgaccacgccatacaccaattgcacgagcaagatggttctcaccctcaatgtgcttcagcatgttagggtcaatagattgctcatatgcaactacattacctttgtcatcatatacaggcagcagtggttcattaccacgctcaccacgagccagtgctttagtgatgcggtctacggaaggcttgtcagtgatacgaccagctaccatagaacctatcgtaaagcctgtaccaaggtctacaccgccagcagtattgcgaacgttctgtagaataccttgtgagaatggagcctgtgcctgtacaggtgcgaagtagtaactacgtgctggaccacgactagcagagctaccctgataagtacccagacgtacataagacttctcaatcaaatcagcaaactgactatcttcagcaacaatcaggttaacaccctgtttagtctcaccaggaatgtaacctttatactggttcagggttgcacgcatgtcagatttggctttagccatttcatctttacgctgtccaaccagataagaagtagcaaaatcaatcccatcagcttctgattgagccagtgaagataacatctcacggtcagtcttactcattgcttccagtgcatacagagtaatcagtttatccagttgagctacatctacagtagaacgtgcagcctgtcgttcacccagcatacgagagattgcagtagcattacgcagcaagttattaccaactgtgccattaatcatgtactgagccagttgcttagatttacggctaatcaaaggccagttacgtcctgcttgtttctgcaaatctgcttccagcttattcacttcacggtcaacaatcttttggtcagtcagcaagtcacgaatttcacccagagacatagtgtcacgcagaacagctaagtcggttttacccataccggtatgcattgctttccactcatcattagtaagcttacggctgaacttagatgcaatagtggtaggcaaatgttcacggaactgctgacggtcagcctgtacctgtgcacgcactgctttaatcaaatcatatacagaagcattgctcttagtacgaccagttaagtcattaaccaggtcatggaaaggttgccataccttaccctggttcattgcagccataacaccctcagctacgattgcaccatttttctctgtagcaatagcagctattagttgtgcagcatgagcagcacctttaaccaacgggttcttggtattagctgcaacttcacgagcaccctctaaagcacgggtagacagtacatcaatagaatccaccagatactggttagcacggtcgatagcattaccactaggagtagcaatggaatcatagaaggactgtgcattgagactcgtctgcatgattgtctgagccagtgcatccataccttcctgtacgttggtagctttagtatctcctgctacacgagcattcagactagccattgcagcagtaccgatgttagtcagcattgcatcagcggtattgccagatttcttgtctactttcataacaggaatgtcagccagtactttacgcacttcttcacttaccattgccagaccaacaaaggtaggcagtaaggaagaacggccttgtgcatcaaactcaatgttgttagcacccatgatggtatcgaacttctgctgtgcatagtaacggtcagcagggttagtactatctgggtcagccatgaatgactcaacggtcaggttcttagtaacatgtgtgtagtattcctgtgcacgagccagagcagcaggattaatagcagcttcagtagccagtgcagcaacaatgttagtaaagagacgttgttcctgcatattcatagtgaagccatgagcctgaacatcacgagttactttagtcgcattaaccactgcatcagagaacttacctttacgaattacttgctgtactggttcagaaccaatgtagtctgtaatcagtttatcaaaggttttccctagctcttccagacgagtattgtcaccatatgctttgttatggaacaaagtagtatctttggctacagcagcagtaggtgcttgaccacgcataactacagcagagttaaacagtaagcctgagaacatatcatctgcattagccggagctttcttacgcccgaataccagacgtttgattgcttcatatacagcctgaaccatggttttcagtgcagtggttttcttctgcttgctaatcaattcacggttggttaaaccccaagccatgtactcgttaagtgcagcagctttagccattgctggttcaatgaagccattagacaaatgaccattaatggtattaagagcatctgcatatgcttcacgtactgcaggagtttcatccttaacatccagagtgcggaactggttcatcaggtcttcaatgttctgaactgcttcattaggagtaccttcatagtgagctagtacagattcaaaagtagaagcatgcaccaattcatgaaccagagtctctaaggaaggagtaactaagtagatggtcttatcttcaaagttagtccaaccgtatgcattacctgcttcagcagcttcaatatcttcaggtgctgggcgagtaatgttcttctcaatagcgtaagcatccagttgaaaaggggttccatagacaaccttgtagtctttagcagcaagagatttctgtacttctttcaatactgcttgctgttccggagacatctctttagccagcttagagatagcagtattagatagtagacgtacaccagacttcagtactcgaccaacctgttccattgccggtgcttctttcactggttctgttttagcagcacgtactgcatcacgacgcttgtttaactcagcatcaaacagttcgttcagcttagctacttgctggtctacagtcagaccttccagagagattttaccgttgttcacataaggagcaccaacagcagccatctggtcaacagtagtctgtacctggttcattactttgtgacgaatatctacacccagagcaatattacgcaggttacgttcaatctgttcagcaccaacacgtaacaggtcatcggtagctccttcacgctggtcatattccagagcagatttagcgatagcctgtttggtttcatcagacagtttgctgaagtctacactcttcatgaacttagcgaaggagtcataaacattcttgatagggttaccctgccaggaagtgtatacagcctcattagctttacgacttgcatcagtgatgttgttgataccaatgttcataccatcaaagattttcagggtattcttcggagcacctttcatagtagaaagggtctgcatcatcatgccatcgccagtaccaatggtcataaaaggaatacctgcaacacctgcctgtgaaggagcatagatgctcattggcacacgcatacggtcatctaagttggtagccagtacttggttagcaacatcagtgttttcactaccggcaatgtagaaagtctgtgaaccagtctcaatcattggagctagtggggataatgattcctggatttcattcagttctttctgtgttaagaaatcacccttcttccaggttgggtctttttctttttctgccagcttagcctgtactgcttgttggaacatgtcttgtagaaccaaagactgaatctgggtagccttctgcaagttctcagtagaatgcatcagaccttccccaacagtattccggataccagtacgcattggttcaacgaacaggtgaagcatgttctcttgtaagttcttcagggcattacccgatatggtaaacttctgagggtctaacttaccagtcagagcaccttctacctgttgaatagacaattcacctttacgcataactggaacattaccagtcagtgcttccatagaagtaaggaaagtatccagcatagcctgagcatcagcctcagacgcagcctccttaccaaacattgccatagctggggaaatactagggtcagcagcacgagcttgcagaacatcactgaagcgttcatagatggtatcagtaattgcactaaccatcttgccagcaataccacgagcacctgaaccatagatggtaatggtcagtgggtttttagcgataccacgtttcaggtccagagtaccgtcttcattcaggttaaagtctttaataaacaggtccattaacttctgaagatgattcatttggttcataaccggaacgttgttacggtaagtagtacgtaactcattaagtgcttgttgcagaccattggtagatgcttcatacaggtcaacactgtcatcctgtgaacgatgttcattcatagtcttaccagctttaccgaagaacagaccacctttagcagtattcttaatccagtctgaagtgaacttaccaccagtcattaataccattgcgttgattggtccgttggttacaccatcggcttcaacgtacagtggggtattaaagttggcacggtcatcactgttcaggtaacgggcatattccataagagccatgagagctacgaatgatttatcgccacccaaagaagtcttcagaatatctactgcatcagctggtaagtggccagacttatcaaactcaaccatcatatcaacagcaggtttcagattaccttccagagctttggtcagcttttcagacatagcttcacgggacatattatgtaccttgatacccaatgcctgagccagtcctagctggaagtcagagaatgtttggctgttttcattactcaagtcaatagtagagaaggttggcagaattgcttcacgaaccagtttactggattgtgggttgttcttacctaacatctgcatacgacctacacgggtcatgttgtaaccatagtgaataggcgtatccagaccattctcctgttcctgtaactggttgattacaccgaacagggaatcatatgccatagacactgacaggtttttaccctccagtgacttagcagtgttcacgttcagcagttcaggattaagagtaccagcacccatcagttccagaatgttgtcacgacctaatgcttcatagaagttaaccatcggcatgtgtacacggaactcggtagcctgttctgctttaagagcagctttctgctctggggtattcttaacagcagggttacgtaactgagtttgagccacggaaggaatatcatcaccaaagtacattttctcttctggttctacgagaacagcttcctcgatagcagtaggaaacttgttaatggcatcgttatcatccagcttctcaatggtatacagaccgacggtcttattagagtctgggtcaatctcagacacatcaagcatagactctttaacttcacccatctcaatgagagaagacagaatctctgtagccattgccattggaatacctttggtataacccagtggtgcattaggattacgattcaatccccagtaagattcaatcttttgagccagtgagttagtagcttcaaccagagtctgagcattctcaaattcagccaggataccttcaggtaacaaggatgcttctactccagtaatagcagctacatctttcatgtctttaacagcagcattctgtgtagcagtcagtcgccattgcagaccagcaagtacagcagtctctaacaactggtcattgaacttaaaggtgtctccgtctttctctacgatattaagtaacttaccacctacccaacggttagcctctgtgccttctgcaaagcgtttaccaacgttcttattagcaagaaacttagccagacgatcagacagagtagtcttcagagtttcaccaaagcccattaagtcctgataacgcttaatcacatcacttgtgagagcgttattttctttttgagtgaatgcttcaaagcgtgcagtagaagacagtgcttgcttaatatcagtcaaaggggattcagaaccaatggtgcgagacttaggttcttccggcagggtaaatgatttcaggaactggttcggtgtcttgtcattgttatagacagggaaaactgtttccattttcgttttagtttcagctactttttgagtggtatcctcattggtgagggtagcatctactgtttcagacttagtagtagagacttcttctgcttttgaactagcctctttaacaggaacagtcttattttctaccactggtttagctttaggctgtacagtagtagtagtctcttgcgctggtgcaggagtttcatcaacctgattcactggttcattggtctgttgagactgagtggcatcaagaccaccttgacggaactctttaactacctgggcagcaggcttgtccagacgtgaatctaatggagtaaccttcacatgagaaacattaagctccgggtaagccgtagcaagtgcgttagcaatatcagctacggttttggcctccagtcctacttgctgggcaaacttaaccgacttggtatcatacggattgacaccaagaccagtacgactacgtacccattcacgggagggagtaagagcctgataatggacagacttattcttatccgcattcccagaaatcagatgctcattcaacgctccgaccttattctgcatgtgctgggcgaacttcataaagtcgtcgaggtaagcggaagccaaatcgaagttaccagagttgtacgcagaacgaatgcgtttagcatgttgcaacgcagagtactgaccttcattagaacgagactcgtcggttttaatctgtttactaacaatgtcttgaggacgtaagcctagttcttctgctttagcgtcaaattctcgtgctccttgcaatagagcagcagcagattgcagggcagcacgctgatgattccccagtgtaatcttaccttcacttgcatgtttcagaaccatgttcactgagtctgcatccagtacttctggagacatatcagcagccatagcaatgttgtttgcttgggcttggttagcttcttcggtagctttcagtttacctgcttcagcctgttcctgaatcatagaatggatggcacggaatgcacgaagtacctttggtgtattctgaacgttagccatcaggccggagaactggtcaacaatattagcagcaggagaaccctgttccagattagctaaagcaccaggatcacggttaatgaagctatccatagacatgatgttgtcatacatctggattgcagcttccatttgaacgttagggtcttcggcagtattaaccaggtcagccatcttctgaatagcttcaacacggttagtggaaccagaaacagcttcacggattgctgggttagcttgttccagttctactgggtcaaatttcattgcctgagttaagtcagcagcatactgagtagcagcagctttctcttcaggagaaatatccattgcatctactgcttcttgtacagttgcttgtgcttgttctgcttgagcagtagcttcttgtgcagcagcattaaccgtagcatcagatacaggggaagcttgttcattacgcttagcaacttcttcgccacgctgaaccaggatgttagtaataggagaggcagcttttgctaatgcactaccaaccagagaagcaccagccagagtagtacgtaaagcaggcccagcagaagcaccaacagctttaacagttgtacctggagcctgagcaacaccagcactaccgaagccgtagagtgcaccaagacctgcttgctcaccgacacctttaagcaaatcacgcttagcatctacattaccctgaattgccttgttctgtgcaaactgacttgtaccagactgaataccttcttctactgtttcacgtagcatgttagaaccagcaccagccagcgaacctaccttaagtgggttaagttcaaatttggataccagaggaccagtagcagcagcaaccggagcagttaagccagcagcaatgatacccgtttcagatgcagtttggcgacgtgcttcatcaggagataaaccatcagcgatatgctgttgataaacaggagacttacttgccaattcttgatgggacatcttcatgatttcggaagcagtctgttggtatgcaccaccagcttccataccaccaattgcaatagcaggtgcagcaacacgaccagcagacaatgcaacctgtgcaggacgtgaacctaactcagcagctaaggtaatacccttaacagctttatcaccacctaccattactttaccgagtgcagatacaccacgaattaatggaccaccggtaaagagagaaccaacaccttcactcagcccatcagtagcagccataccattatcaagcgtattagcaacagaatcaaaagcatcacgaccaatacgagacagagaggcaaccaaactgctctctccatttttaatgtcttcttcgtagagtttctggttcttttgtgcagaaatctggttctgattctgaacaaccttacgggtagcattcagagcatcagactgtagattgtgtaccccttcattcagccaatccataccggaagcaatggatgccccggcattatcattgaccagacctgtgccaagagcagcaatgcccccaagggtattagcaacaccaagaccaacaccagaaagagtatcaccaaatgcttctgcgttagtacgttgtttagataagtcctgacgtacagcatcagcagcattagcccggctattaagaatctgtagaccttgctcattaccgtatttattaagaatttctaatggggaggcttgagtgaaatctgcctgaagtgaacctggttcgaatgcaccgattccaagattacctacacgaccagtttggagattgtaagcattctctggggttaattggaaagggctttgcccttgtgcagcttgcttctgagaggttgcagtagagacatcgacttgcttagcattagtgatgctgtctgcgaaacctgccagacggtcaaatgttgacatagcatgtttcctgttcaaacttatatcgtatatagaaagcttactctacagtaagccagtgtaagaaaaaagccccgaagggcttttgttagtattaccgattttgtcttggttgcatatactcaggcaaaccctgtgcctgacgtaaataccgtgcagcacgttcttcatcttccttggctcgtgctctgtccacactagcctgtgaccggaaacctcttggagccaggttagatgggtctgcttgaacttgtgcttgagcagcttgtagcattgcagcagctttagtaacagcttcctgacgagcaggcaacaatgcagtaagtcctgtttgtccggtgttaatcttgttctgggtatttgtcagtgcagctacagcagcatcataagcagtctgtgctgcctgaatattctgcatggcttgagcacgaccaaggttacgcacactgccttccagtggttcaccacgttgtacaccctcaattaactgatctaccagacggtcattaagacgcataccattaccagcttcattggtaatgaatgggttaaccgcatcaatagcacggctaatgtaaccttcaggtacaccagtctgtgcacgttgcataacagcagcagccatagctggagacatattcccacgttgagaaatatcagttaatcggttaagtacccagttacggtcagcacccttaaagtcaccatccagtagacgattagcaatctcacctactggagtattatcggtgacagtacccaggaaatcggtattaaggctaccggtattatcctgcatagagcgagtaccaatcataccctgagccaaggtagatactgcctgatttccctgattattctgaagcagagagaatgggtcagcccctacttcagcttgggcaataacaggtttaatctgttcccaagtcatatccttataagcacctggggtagagttaggtaaagcagcccaggtatctttaaggttaccattcttacgagcctcaaaaatagccctaccaatcttctcctggttctcaggggaaagaggttggttctgccaatctgaaccaagaactttgggggcaaagtctttcaaggtagcttggttaatctgaaatgcaccaacaggagaagcaccctggttcgacttcataccatcctgatgcttgattacatcaccgatactcatttgagtaataggagtggaagtaccagcaaactggtaagtaacatcataaggggaaccctgtcgagtaccagcagtaccaggagcagatgtagtacctacgccattaccgtatacacctgggtaagcattagccagtaatccttgcaaacgtgcctgagcaaccggagacaggttcctgctatatgcctctgccaacagacgtgcatcattgggattctcagcaccccgggtaatctgtgacattacacccatagctgcctgactatcagcatcattacgctgagacacacccaaatcaaaacggttctgtgcttggttaatagcctgaccaccttgaccttgaagacgtcccatcatctccagttgctggtcagcagggagtgcagatagtgcctcacgggtctgccccaatgcagcattaatacggttctggtcaccagactggtaggcctcggacagtaaacgaatagctggggaagcactatctaatgcagcatttgtatcctgtaaacgaccaaagagataagcattatagtcattggttccctgctgaccttgttgagtcagaagagtacctgctcgctcatccagattctgtagagtacgctggtttaccagtgaagggtcaaccccctgaaacagtgcaccagatgccaaagcattacgatactcagtagggtcttgatactgcatagcattcatcatgacggcattgccagcctcctgcttggcagcgttctggaaattacccagtgcatcacttaagccggaggtggcgttacctatcatgctaccaaatgtgcgaatgctgtcaccaactccagagaagttaggtgcatcaacattacgccatgtaatttgagccatgatggtttcctattaacgggttaatttattagctgcaatataagcatcagcagtagactggtcacggttctctgctgtagcacggctacgagcacgatcttccagtgcagtgttataagacttaatctggttattcaggttagtgttagtaacactcttagtaaagttcaactggtctttggctaacttattagcctggaaaccactgtagatattagctaatgaaccaagtgcacccagtcctaattggaaggtaggtacattcaatcccaactgatcagctgaaccagacaggaaagaagcagggtaggctactcctgtatttgcccccataccaatagttgcacctgggttatagttcatagccggggtattaaagttctgattgttattagacatccaagacatagcagctggctgtggagttgggttgcctgttaagaatgacaaatccatggggattctcctgttaaacaaggtcagtattaagagtcatatcagagtagttgccaaccatgtctaaagacaagtcagctatatctgaaccagtcatgagagtacgtgacaagaatgaatccaacgactccattgacacgaattgcatggggtcaatcacaccctgtccagcagtaccgaacatctcttcatactgcttattgattgccatcatatcagtattgtactgctgcattacactctctgctttctgaatagtagcagccgtggatgcattaatatactgactaatgccattacccactgaactggtaagttgcatgatgttttgagcactcatcatttcaccagctaaagaggataaggatgtaccagtagacaaagcagtaccaacgttcatggctaccattgaggcaatagcagcaatgataaaacctagcttatcaccgaacagtgaagtagatactttagtaataatggataccagaatcattgcagctatggcgtttgctacagcaccaactattacagcagctaatccaacaaaaccaagtgatgcaccgactgcaccgtatgccccaagtatacctgcaccaccagcacctgctgtaaatacagagacaactacagctaccactacaacaacaattttaaatgccccagtctgataccacttctgcttaaccttcttatatgagttcatcactaagtaggagcaggcagtggataactgagtgctacgaaccagtgacattgaacggtagatattggtgtgcagtggaataatgaatccactctcctctgcatcacccattgcttcggcaacatcaatgtgcactgacttatttttatataccctgttgttgtgatttagacccagtactctaagtttacgataggtattattaccatcctgccaaagcaactcgtattcctgcattgaatagaatgtgtatgttacctcaagtttcttagcagaaccggagttggaagctgtccttatgttcttacgagtaagggttatatctcctgcatacctggctcgaagttgcccctgcttagcaccagaccatgcttgacctgaatgggtagtttcagatacatagttccagccaatagtcatgtcgtacttgtactgcttattactatgcaccctaaactctcgcttaggtataactgggtattctggcagtggtggaggtgttccaataatatgcccttcagtcctgttccaccattccacatatgtgtcaactgcatcatttgctgcctgatagcctgcaatcactgcttccagtgttgggtaggttgggtcaggtgggaatgcttcagtagccatctgaaagaaacgatagatgtattccttagcactatcctcgggggtattaagggatacaccaaatgaaccatagatgtactgaatatcacctatgtcatcattcttcttaagctctgtgactactttatcaatttttccaccagtagctttataaagggctttcttacagtgtgggtagattgggtcattctctacccattgcttatcatttctgattggaatgaatgggtagaatcggttatcagtagcttcagtctcgaacaaagaatctagtgcaacgttaccggagttctgcttataaataagcattttaggtgtactaacagcagtcatctcggtatcagtacgggtagtctgggatgagtacttacgaaccagtgtctctgtggttgtagtgattgtatctgtacgagtaacacctccacctatatcaaccacattagtagttacagaagtactggattgaatctcaccaaattttgtatgagtcattaccctgtcagatacaactacagtcacatcatcaggtttctcagtgaatcctctacgataaactttaacgtaagagttccagttatccacacttggttctgtgacagtactgtcttcatccggtctgccatcagagtaaacagaatgagtatgtatagtcttagtaagattggttgtgttagccgtcgtatcacttgagacggtagtccataacaaagtggaaggtaagtcatcctcatcatcatagacagtagtcggtcctactaccggaggattagtagaaggggacttatagaatgagtaatcagcatagagatataaagcacctggttcaaagttagtaggtgtgaatgtaatagtagagcctccatctaaggaggtcatagtgatttcattagtatcttcatcaatatctatgtcgaatcgttccatgattcgacttggagcattctcataaagatactggtcacaccattgctcaaagtcagcaaagccaatctctgctgcctgaacatagactgattcaccagcagggggtgtaatttgaccctctataacggtagggtcaatcttagccaatacacccaatgaagaaccagccataccaactactgaatcatagtggttcttactccagctggagaacagtcgcatacgaatacctggcccattcagataactatcagagatagtatctgccatagtgaatcctgtattggaaacaatattacctataactacagtcttcatatagttagggcgtttatgtatatcccctgccatgttatagacagaggatgctacgtatactttggtcttcccactgaataagcccatattagttcagcccgttgttagacttcagcttggtcagaatggtgtcaatacttgcgttagtgaaaccatttggtggattcaagccttcatcaatagtcttctgagtaatccatgcatcagtaaacagcttagatgctttaacctctgcatcacgttgataagaagtaatctgttgtgagtacaactctttctgtttacctacagaaccagtaacagtagctccatcactacgggtatcaagtgtctgtgcacgttgtgcttcagtctgctcagtaagcaatttaagctgttgaggtaacatctgactaacattaaacaatgcagcacagtatgtttcagactcagtagcaatcttcatcttagtaagagcatactcactcttagcagacagtgcctgaatcttagccagcacaaactgtgctttaaacgttgccagttgaacacgagcagtaactgcctgaatctgtgccatagcagcagcccagtatgcctggtcacgaccaagtaagaactgaacagcattgctcatgcaagattccatcatagcaatgtatgctttggtatattcaccaccggtaatacggttagctttaaactcagctttcagatgattgtgtgcagattccattaatgcatcaaacgtaccactaccaccaacttcacgggtagtgagtgattcattggatattttatcaatagcaccaaagattggggaagcatccccaccagggatatcccattcggggccagtcatatcaacatcaggaagggtaaagtcatcacccttagttaactcttctaggagtcggttagcttctacctcagcagaacaagacataatcattcctcttggttcaaaaagaaacggcccacggagttaccccagtgagccgtgttgaactgtagcttatacgttaatcgttcaggctaccagcagcaatctgtgcctgagctagttgagctaattcagcttcagtcaacggaggcagtacctcaatggagaactctcgtgcttcagttgcacgaatatccggtaagccattcttacctttacgggtcgtaatgttgatgaacttacgctctttaaggaactcgtagatacaatacggaatgtgataaccattgtcggttacttcaccgaatggaacaaacttacgcacagtacccatatattcgttagctacggtgataatctcacctggcaggtctttcttcttagggtcaaggttctggatacgtacacgaatcagtcgagtctgttctgcacgaatcttttgaccaagagtcatcttcttaacaccagcttcctgtttttcacccagcggattaacggcagcttcttctactactggttcatcttttacttgtgcagcttcaatcttctcacgaagcttttcaacggaaatgttgttagagaacttgatattcatcaacgttgcacgttgcttaagaacttcaagttcgctaggcattgcaatatcgttaacggtatcttcgttgccctgtacgttcacttctacgtcagtggtcggtttatcgttaatgctcatgttcatatttcctgtggttcattcagttttattaagagggggacattagtcccccttgttttatttcggactattacagaggagcaacagtcttaatcatagccagacgttctgggcgtttaaccaggataccgtagtaccacttgatagaactgaagccagtttcaccatacgggtcattacggtcagcagtttctttaccaggcatcttagtcatgatggagaacttaacagacttaccatcagtctggaagccaatggtagagaaggagtcatcaccaactaccagcatcgggaatacgtcgtagtgttcctgaccaccaaccatagtagaacgatagcctgggttagaagtagcctgagcaccagcacctgcccaatgcagcatctcaggaacctggataatacggaacttgtcgatacaaccaacttcaccattcatcagagtaccggcatcagcatagtgctgaatttcgatgaatgctttgttaccgaacagatctttcatcgctttcagttctggaaccaattcagaaccaacgtacattacacgagtaccaccaagtactttggtatcagtcagtttagaaccagtgataatagtagtctgagtcggggtacggttctcagtaagaatctggtcaagacgcatcaggttcttataagaaactacagacggagtagaaccttcaccggtgatggtagcatcagaagtagcagcacctgcatacaatacagtaccagcagcagcaagcaggtctttctggagaacagcttcagtcagctgtacagcaccgttcatcaattcgcgagacaggtgttctttcagttgatcatcagaatcgaagtccagggactcttgggtaaattcgtagaagaaaccgaacttatggatggagccttcacgagacagacgggtaaagcctacacggttaacacgaccaccgttctctgtcagcagaggcagtttggaagtgatgttaccaacgtctttagaagaaccatacaggttaccattaacgatggtagcaccattagcatcaataccctggtcgttaatgttcttatcgtcgagcagaggaacgtactcatacaccttaacagtcttaccgtagttcttcggcatgttaatggtgttagccagtggcatgaagtactggtctttacgagactgaataatagctttcttcagccagtaaaaggtattcatctgatcggaaccagcaccatcaatgctagatttctgaccgtcaattggagcgttatagtttaacatatcgtattattcctgtttaaagactacccggtactgggagtttagcgaaatcttcatcactcatagcgagtgggtttacaataggtgttgctttgcgtgtagcagcccgattaagggaagctgctttagcttgctcactgttagccagagtctgcttaggttgtgctacacgcactaccggctgaactgctggtttaactgcttgtaccggctcaggcttagctacttggttaaatgctccctgttgtgcaaggaggttgccaacgtagttataagcctgaatgaacggagtacctaccggaatctgacctaacatctgaagacggttcacttcatttgcaatggtgtcataaataccattctcacgttgttcgtgaatcgtatggagtaagccacgattctgataaagagcatctttactggcagcatcccatgtcgagccaataacacctaatgtagcttgtccttcttgagtagactttaagtcgtcaatttcggttgcaaaatctgcttcggtgtcggtaacacggtgattgccaccctggtagttaatttcctcatctgggttaaaatccagagggtctgtaccagagtctttgagcaacttcttaatggcctcaggattcttcttatccaggtcaatcaggaaagagagtttgtcctcatccattaaaccgttgttctgtaacatcagcattaccttacggtacggctgaagttcttgcatcttacgagtatagttagcacccatctgcatcaggctaatggcctcctccggtgaacggggagtaatcattttgccgttagctttaaaaggagccatcaacttctcataaccttccttatagttgaagtcagcaggcagaccttcagactgtttgccttcttctttctgttcctggccgggttcagtagtagaaggttcagctttagtaatcggcttaccgttactatcaacttctgtgtcaacaactttatcatcaactttatcagaagttaaagaatttgctgcatcttcttcaactggttcggtttcaggggaggtttcttcggttggtaggtcttcaacagcagaggtgtcaacttcttcatcaggagtctgtacgccgttggtttctgggttgttctgagtggaagtatcttcctcagcgataactgctggggcttccatattcagaatctcatcatccgacattgcgagaatgtcggaagctgtggttgcagcttccgtagtcataggaaatatctccggttaattattcatcttcaggttcagcacgaactgcatcgagttcttcttctacctgaagaataacgtcagcttcgttttcgcccatacgaatggcgaggtcgagccaacgacgtaagtgaccagcagcttgagccatgttaagtgcatctgcacggttatttggttcaagcagtgggtcaccagactcctgcacgtaacgtgcacaatcttctacacagaactggcgaagaattactttacggaacagtggattctccagaagtttacgtacatcttctgcgtgtgcaactgcacctttagcagcttccagtcgatgttccagtccagcgattgttgattctttactcatgtgaaggtctgccttacaagttcatgccaagagccgatgctgggtcttggctagggtcatagaattgggaactaagtgaataagctgggtcttgttgtgcagctaagtcacgttctggtatagagttcccgttagtcaaagcgttatatccaacagcagcagatatgttgggggtagtttcaccttctttagtaggtgttgtcaacgccttagttatctgaaggttttggtttccttgggattgtgctttttgtttttccatatcacgagcatgtttagtaccagattcctgttccagataatccaggtctttaaggtcaccactagaagcagcttctttagctttagcattattgagtgcaatcttactttgtaactcttcattctcaagctgtgctttctgaattgccaattgcttaagctgttcttccatagggtctggttgtggttgccaagtacgtaactcatgagcaaggtctggcatacgtttaagttctgcaatcttagctacaagagataacgtaatagactggtcaactgtgttgcctagtgtttgaaccatgaagcccaaatcctgggacttctggttatcaatttcagcagtgttaatatcaacctcaatgtcgaagttacctttaaggtcttcacggttaatctctacatactgttcgttagtaatacgtactacttccttctctgataagaacacagcattcattgcacaaatcttagtaccaatgtctgccatacccttagctaatcgacgaaggattgccatctcacgtttagatgctgcatcaagtgcaccacgaatgccagcagcaacatctccgtaagctgaaccagttacgccgccagagaatgctttaacacctgttagagcttctgcttcctggttttgcatctgagtcattactattgcagactgaggcaactcagggaacttgtgttccataatagactggctaggatttccctgcatcggattatattcatagtcttgcccatcatcatatcgacgacggttcagagtatctaacatccctttaggataaccacgctgaccatttgcacttcggcctaacaggtcaatcattccacgaatagttgcaccaaggattgcttggttatctcccaacagttcagcatcagcttcaccgtaaagttcacgtttacggggcatgtagggaacaactactaatggtaacttgccatcagggaatgggttcttctccatacgaataagagtagaaccaatccaggtagcaacaattggttccagtgaaccatcatcattaatgtcatagaatccccagtactcataagcaactactttcttacgaagtgcatccttaaactggaagtcaccaggagttttgctttcatggtctgggtcagtaatgggactggaactctcccagtcaatcttatccagattgtgataacggtctttgtttttcataaggtctgctttgcaagtctcaaaggagataactgcatacagagccttatccaaatcaccattacagcttgggtcaataactacgttattagggttaagcatctcaacggtaggtctgttaaccagtgctttttctacttctacttcagtgacccctgtctgaattgcataagtagcttctccagtttcattgaagtagttaacagcttctttgatatcttctggcattgtttcgtcatactcacggggattctctgcctgaagctgcaaagcctgttggagaacatctgcttgttcctggttctcaattggatacaactggaagactggagtttctgttttaatcttaatagtcttacgttcccaaccgatacgagcaataccagtaccgtcatctacgacactatgcacgtaatcatctaccagttttactttattaagctgagtacggaattggtagttaagaactagctcattctggcgtgcagctaactcatcttcaaaagtaaccggagttaccttaaatagtttgttagacgagaggaatggttcagacaatggagcataacgccactctgcctgacggcgaaccagtctaggctggacttgcgagcgtcccttaacctttgggggtttagccttaccctttacttccattaaatcattccactcacgaatctgtgccatgattgcatcgtgagcaggtttagcagattccaaatcacccttcagtaattggatacttggttccttcttccagtccgttaacttctctgattgagccgggtctggtaaaggcttaaaagtgtcttggtgttccatagttattcctgttcaaaaagtttacggtcagcctgaatctgtttacccaactcaattagttggctgtcacggagtctaacagttgcccggagttcttcaaccaaacgtctgccttcttcaagactattgtcgagtctggctgcatggcttgcaagacttctgcactcaagggttccggcttcggcttgacgtttatataccgatgctcgtctttcagactgttgcatccggctgtcgtaatcactgctaacgcgagcaagctcgcttgcgtaattactctcagccgtctgcaaccgggaagtgagtaacccgacttcataactatggtttctttggagagcattgtatttgtcctgtaatttttgcgttgccttttggtcttcgaccttttgggcatcccatttcttttgaacagtagactgcccattggaattgccccaaaagtaaatggtggccccaaggaccaccaccagaagataaggccaacctttagagattagcatcttcattacatgcctccagtggcacattgcctattcggttagctacccaaccatacgtaaagtctggcatgtttaatgaggtatagtggttcagttgtttagcatcaagcagcttaatcattacctgacatgctgcaactttgccccgttttttctgtaatgctttatatgcattaacagtacttgtaccgactttaccatcaacctgtattttagggtagtctttgccattacgtgacatttcattaagagacatctgcaaccacttagcaggacgggttacaccagtattaacaccagcatctactagcttatgcgttacagcaggagatatatcagcgaaggctacgaagttaggtttaagtacatagtcatcaatgtatatctcagcagccatctctttagataaacccttcatagaaccatcccaaccatactcagtagccagaacttctttatgagtcttagctactgattgggtaataccatgattagtttccccacctgggtcacgaggattgtttacataacctccttccatatagaacactgcccccagaatagcagcgataacccctcccactgcaccaccttttgcagcaagtttctgtttagctttcatgtgaatcttcctttggtcggaatcgtattaatctgcctatgatgtttaaggcaaacagtgcgattgcaatattggaaccatggggaatatcttccaagatgtgacgaggtaatcctgtcaccattggttggatgatatctacagcagagaatagaattaaaccaaacgtactaatttgaatggatgcccatttccagcatcttttccagttaggtactaactctacttttctttttagcctgcgaaccatgcgaatatctcccgtcttgcagcagccaatacaccaataattgcacctgctccagcccatacccacttaccaaaaattccagcaccaacaactttatgcttaatggtgatgaactcttcaatagtaggttcattcttagctaagctatcctccacattttttagtctattgcctatgtcattgattgaatcccgtaattctcccagagtttcctccagtttctcacggtcctgtctgtctctcgtctgattctcaaacagagtcttcaatcgttcctccagtctgactagaagcagttcgcccgattcattcataatattaccgtagttgtaaagttaagaaccccaatagggtcgtatcataagatgactcttagataatacttagtatgatgggatacatccagacatagtgtctggtatcaactgcgaggtaactatgtctattaaagatattttccaaagtggtaaggatgttgtgtgcaaaatgaaggggggattgttggtcgtgggaagttatggggaacgaatagtttctgctaataacatctcagagatccccccagaactactacctttcccaccaacagagttagaagacacattccttctggacttgtatacatggaccgggagccaggcagtaaatgaccaatcctggttcaattacttttcattaccagggataactaaatcacctggaggtacagcagcactaacaattgaagaaggaaatcttaagttccccattagaaccaggaatacccaggtaatgttcagtgttcgtatatcaggaattattgcaggtggtgcaggtacagcaagggaatggagaacacaaacaagacgaaccaatggaattacgatagtaggttcagatgctagtgttaaagtacagggtacagacattgctaacagagataacgtactggctacttacacacttggttcaactgaccctttcatggtagacggtattcagttaggtatgtttaatatctcaggacaagtaattaccctaacagcagtatcaattagggcaatgcaaacagtaaactctatataagaaatattattaatagataaaaacaaaccccgcctgagcggggttttatacctagataagtaatagcctggtagtacgtaggctactgttaaccaactctactgatctaaccgtaccagtattactcacttagacataacagctaatgcttcctgcatacgcttaatagtacgccgcatcaacgcagcctctaatatcagtacttcctcgtaacgaataccgtagcgggaacctgctggtgtaatcagtttacgagagccattggcatcttcctcgtatacatcatcccaactgtcgaagcacaggaagccatagcgatgtgcatctataccgtgacgttcgaatgcctccttagctcgctgagcgatgatgccgaagtgccatctagctgagtctgcacccttctcctcaattcggtccaagtactgaaattgcacaaagtcaacttcagaccaagcatccagtaaagcatctgagataataagaggctctgttttatccctagcatctgagataacagtgaatgctgattgagtaaaaccgccagaccatgctcgacttgcggaacctaatgcgtatgtatcagtactatctggggtcattgcattagaacctaactgcaaataacctgtgctactggtaggaagacgcacgttaccgttggtgagtgatactgtccgagaagtaccatcagaagtaaataggcgaacttgagaagaagtacccccacctacagctaatgacacagcaccatccccaagcattctgtacttatcagccgaggtaagaacgcctgacggaagtgacatggacttaatccgccattcgaacctaccggacatactgcctatgtactgtcctaatgcaggagcgtgcactacgttactattactagtgccgtcaatagtaactgcaccttcaatagtaccagtagcactgagaaggtcgtttctccttcccggatgctttacctctacgaagttacgggtagaacctgattcgaaagtaataacacctgtagcactgtagctaggaaatacagacgcatagttgttattagctgtatctataaagcgcgcaattgtagcagtttgagcttgccctaaagagttagtaccatcacatcctgacataagcacattgcttattacgttatcagagccttctactgtaacaccgtgagcctgactagcgtcagagattgagaaatctacaagcacatctgagattaagttggtactacctttgcctgcaacaaccgctgcatatttaggattattagccactaccccattgataaggttgttagagggagctattgacccttctgtaccgttgtaagttacatgctggcagtctgcccctataacattgctgactatgttataactggctgtacctttcagttctacagccccgaactgagggtagttcttagcaatgacgttatttatgagggagttaaccgaggaatcagcaagtatgcatccagccgccttattagtagcatagccggagtagctacctcgaatgcctttaatcataagcccatcagagggtgcatcattagggtatgtgattaaactgaaaccagcgcccttaacgtttgagaaattaacatcacttatagtaacatcactgccaccagcaagagatacctgctgcccttgagtggtatcggtcgccttattactttctaccgtaatattacttaagcgacctgagcgtagattgttaaatactaagtagttacctgtacttgaacggtgacttagtacaccactgcctctaccgtctaagttacagtaattactattaataccagaactagagaatacaccgtctgatgctacgacagctttttgagaatttagtgaagcagctatattctccgtactatctgttacaccatcccctttagcaccccagcctcgaacatcaccctcatcacgccatcttgccatctgcaattcagggtaactggacgcaccatccgggtctgaaatctggctgcgcagggctgcatcaccgacgctcagccactttcctgtaccaatatcaggaacagacccagcatctacaacctttggcagtgcgccatcccatcgatacaacccaccctggtattcaagacattcattctttactttaatctcataacccaaagagaaggacccagggactgttataaactctcctcgtgaaacagctagtgcacccaggtcaacattaccagtagagtgaactaacacaccggcagtattaaggcttacagcagtaacccctgaaccaaggtctgcaggtaatgagtaagctcgctgggtagtcttatcataaatgaccttgtattcccctaagtctacacctacagcaaagtaaacaacctcattctgcttaacaccaaacttacgggcaatggcttgtttgttggtaagaataccagtggagcctttaccaccttgtgagaacatttcgttcataagaacctctttgtttttctggttaatggcgtccttgccgaatatatccttatgtacacattggaagattatttaaatttttccaattgccgacgaagaaatgcacacttaagtacgggagatttctcataactaataccgtatccacccctccaccaacttaatggcaaaatggttttgtttattacttctgttcaagagcagaaagtctggcttcgattctttccagttttcttctctgataagcggcttcagcaaagaaaattccgtcaggccgaacaccccactcctcaccctcttcatgaataaccacctcggtgtatacaggttcttccgtagtagtgacattaccctcctcgtcagtgtgttcaacgatttcattgtgtgaaaataccgtatcggtcatccgtggatacttgtcatagcacagaacagcataacgacaattcgtactgttttcatccatcagaccatgtgcaatgaatacatcacgaatttgttgagcaataaccccgaagtgaatacgagcatcattgcctttcagttgaacagcatctaaccactggtacatgatgtagtgaacgtcaccccaggcatccaggaaagcatcatcaaaaactaccggctctgttttcttctctccgttagaagtaacaatagggttacttccgaggtatgcagtggtgaaacggttacttggtccaccaagcgcaatgacgttatcgttataaggcttaacatcagcaccctgaaacagatgttcatttccgttgtaaactatcctgcgagaagctgtgttgctcgcaccgtaaagcgtaatctgtgcaccagtagaagaactggttccgtctcccccgcaaaatatgatgcgctgccctgctgggttattagtcggtacagatttcccgataaacccatactcaccttccattaaaacttcagagcgaatgttactactggtgctggctctaagggtcacatgacctaaacccaaatctcctgtaaattccattggagcaggaacagtgcgaatcccatttgtatcaaaaaacacggggacagctctgtcaggtacagcaccatatctgaaatccctggaaacacgattgtctgaaccaatcttcattttgtagcaatacaaatctgatggatgaccatctgatttgaatgggtctttcgatgagttatctccatatgtccaggggttcagatggtcttccccaccgaacaagtaatagatataactatccttaacgaccactgagccaacaccaacgccagagttgacaatgccaccctgataaatctggtcagtgatatttacccattgagtattatccaggttccaggtgtctaggttcactcgcgtgtaaaacgttcgcgggtaagaactgaaatatcgctggtcgggtgcgtttgcttcccactcgttgtccgcacgttctgttccaaaaagaatgagttcgtttcctaccttagcgaatggcagggtggagtggtggacattattcgggaacctcaatgattgccaggatatacccaaatcgttactacgatgtagtgaactacccagacgatccgaccgagttccacgggttacaacataaagaacaccgtcaaaatatttaacacagggttctgccgcatctggctcatattcagcagggatacgtcgttttatataatgcccaggattgttaaatgcatccgggaaatacagcataccaacttcacgtggagcagcatcaccctggtgatatcccatcataaatgaatcattattgatggcggtaaaactgtgaacctcggtaaccatgggaatcagtccaaggttggttttacgccaaggtgactggtggaacgatgtccccatatgccagactttggtagagttattttggtcagattcctgttgatttggcgtggtgacagtaaatgtgttgcggtcaataactgaagttacagtcatattccccgaaacaccagtcaccccagagttcgagaagttaacaaaatctccggcaaacaatccatggtcaggaatagtaattacagccacaggctgattagcggcttttgtgataccacctgtcggatggtaattacgggacataggacggtcccatatctcacaggtcaccagtgcgttagatgctaaagtacgtgtctcaatcatcgcaaagagacgattacgcatcacccccatactcatacagtggtagttaactgtcgggtaatcaggatgtaggtcggttaaccattccggcgttgtccaggtctgtccgtcatcccctgaacgaacccaggatacatgcagcctgctgaccccatgtctatcactagccatgaacgggcagtaaataacatcatcgtaaacgaacgctttatcctgtggccacgcattgtaataaggggtgtccgttattttgaaaagctcgccctgaacaaattcttcagaggcataataaagcggctgaccaggaatacgctcataaacaaaacgagtgttgacgaatcgactaatatcaggcaaggatgtgaccttatatgtcttcccattgccattaatcttttgtccaactggtgtgtcgtttaatacgttcgttaatgctactgtatcatcatgcacagcgtcccctttaacaccccaaccacggacatctccctgattacgccatagggtattttggtcagtttcttttttggttagtaactcaacctgaatgttacctggagtatatgtaaggatattaccaactacgctggatatatacacattagttggtaattctggaataacgtaaatctgctgattatcgggattataaataacttttttgttatttaaggattgtactgtattagtactgagaataacctcagaatcttttacattagccgccacgagccacttcctgtagagtacgatctgttgcttccaatactcgtgcttcaccaccaatctgtactatcaaacgatcattggttgtcagtggttcggtaagaaaaatacgttggttatctgggtcagcagtataagactcagtagttaatcctttatacaaacgaagaccattcttatacacagccggaatagactggaaggtatacggaatagcaataacctgctcaccccctacagcagcaccattgttgtacaaccaattgatctgaatccagtcattaatgttaggattatccggtacagcaggaacaccagtcagaaggaatactacttcatctccttcctctaaaggttgagccagagttacggacaggctgtctacgttgaactcaaatccacgacctacatactgcatgtcgccattaacaataatgaaaggtacacccaccgtaccatctggtacgttgattgtggtttccccaccagtagcagaaccattactgtatacccaaggaatataagcaccttcactggaagaagtaccaccaccattggaaccagaagtagcaacagtaatccacgaaccagttgcttctgagtcatctgggatgatgccagtacgatcaccttctacgtacaagtaatcagttacctgccggtcacctgcacgggagaaaccgtagatacgggaatatttaacctgcgtggataatgccttcaattcctcttcagagtttacaccgatgaccatcccatactggttcaggaaatcatacaggagtttaagattacccaggttgcagtacacagtacgaaccacatggtaagcattaccaagcagtgcatccaccatttggtcattggaactgctatgacaatatggattggtccaatcctgatttgcatcaaagggggtatgtgcgttcatcgccatcctcgttgttcaaatttagtttcggtaattgaaatacttccattagccaggtcgtaatcaacaacctcaccacagatgctttcatatgtttgcagatgctctgctgctttagcgttagcttccggagtattcaaaccggtgtggtaacgataacccacccagttatgaagtgccgtcattagcgtatcagctaaatcaacttcctgttcttcatcacccgtaagcactgggtgcttggcttgatacattacgttaagtgcctcaaagtgtcgaggacgcatacactgaatagtatcaggccgtggagtgaagatagcacgagggtccgaatcatcgttcagtctacgtcggttccctgagttatcaaatacatttaagattttaataacatcatcctggaaaggtttcatgaacccatccatgatgtatggatactgaacctcaagagtgggcttagtaaatctggagtaagcatatctggattgaagaggataatcggtacgcccttctttcatctccacaatacaactattagttctgagagggaaacgactatgcagtcgaaccaatccttcattaatagctgccagtatctcaggcttactatcaggctcaatacacaatctgtcatccgtgactgcaccagtacccttcaaggtacttagtgccaagccacggtatacttccgataatttttgcatggttcctcacacaatatatgaacgtagggggttaacactatcttcttcttcatcgtcccacatcgggtcacccttgttatccaccatagtcatacctgcctgtggtttccagggattgagataacccagcatagagatagtatcaatacagtcatccttacctttgattccattaatggtagctaatttaatctggcccatgaacaaacccataatagttgaatctctcaactcttccgggaagtacatcttaccagctttgaaccatggaactacctggttaaagcgtgacagcttagaggttacaggacgtatgcctggcttaccaccttcagaggatgcaaagttaaagaagacattacggttaatcatttctttttgaaggagtgagatgaatccaccttgttgacctgtggtttcgaccccaacattttgtggttggtattcctgaaccagacggaataagtcatcaaagtttttatccataagctgacgattagccacaccatcaacccagaaccaatctccattagaactataagcccaaactgaaatgacactgtagtcactggtctgtttctccgaagtagcaaagtcagttgtaatgtaatagttgtagcaggacttcatccttaatagttgttgtctgctataccacctaatttcactatcctgaaccagtctctcatcttcagaactaatacgaagcataagttcctgatagaagccagccaacttaccagtcttaactgccatatcgtattgagctttgatgtagtcatatgagaaacggtcatcccatgcaccctgaaattcttccctgctacaggggaacttctcgcatacaggccatacgttgacatcccatgcaccagactcaactgcttcaatgataatgtcttccttattaaagggagtaccattgaaaattactttacgacgggttgggtcaagagcatggttcacacctttatagacggtatccttaatagcttccatgcttgtcttggagttagcatcaccatcgctaatcaagtcatccagtacacagagtgttggacgtttaccatatatcttcgtaccacgaagacctgtcttagcaccaaacaacttaacaccaagtcgatgtccttctacattacggaactccagaaggttatctgtaaatgtagcctcaggtatccattgctgaaggaactcactattcttgtaacggaactcaatgttcttacgtgcagacttagcaccgttatccattgagtcagatacgtaaatcattccttctaccttacccaggcttggtaaatgaccaaacactgccaggaacaaagtaaagtactccatgaatacagcagttttacctgcaccacggaaacacaggttaactacatactggttcggactaatcatcttatccagcatcttcaagtgaactggaggtgttttgttagattcaccctccttaccattaaccaacttaataaagttggcaaaggtaagagcaaactgactaggaacatagttagaagaattaaggtgggagtaatccacctggtctagccattcatctagttcctgtttaattaattcagacatttgtaatgtcctcatctgcacgtactagtttagaaccagcaacctctttggtaggtacaccactattgattgcattgatttgctgttcagctaatgcagcaagtgttgccttgaggtcagttaacccggagttctctcttaagtccagattgatattcgttacctggtctttcggtttagccaagtgagtaaggatagagttagctgcatcacatcttactttctcacttgctgctgtggtcattagttcaacctgaacgttgatagccttttgataattgtcctggttcacaatccacactggaaccaaactttgttccatgatgaggttaaccaatttacccctatggtaagcagatacataagcactgatatctttctcactggttcctcgtgctacaagttctgcttgtcggttagggaatgtcttaaagtaggcttccttatttgagtagcccatgtgtttgtaagtcacatactgaactgcattcatgtagtcctgtgtcttaaacttaccttccttcataactccagagtaagagatgaagttttcacggaatgcttcagcaaccagttggtcttgggtaatgttgttaattgtgtccaccaactcctgggttacactgttcttgaagttagcaggtagggcattaacaatctgctgcttagttagttcactcatacttatctcgctacaaagttatgtctattaaagaagattcttttcttggggtgagttaccccttgaagaaaccataccatacagttacactttagtcatgatatagaaaaagttcatgatactaaatagtatgtaatgttccgatgaccctattcctaaaaggagtaacatttgagaatctatatgagagtccacgactccaaagatgaatacaaagaactagaccataccaaggctggtattctttcagatgatattatcattacacatgatgaagattcctaccatgaattagctgggatgatgctattagagaatcgtccaggcattaagatcttagaaccaagagaaacttactctttagaaaagagactttcagctcttgtgttcttcacaaaattacctcatagtgtctccgtcaggcgaagcaaagatagtgttcggatgatggtgacgatgtgattagtcatgccgcctagtagacagtggcggtactcgtaaagagttaataacttctacagtcagggttacccggctcctttcctacctagtaggctaacgatacacatgtatctagggtgatgaactgacccgtgattgaaaacggtaaggggtagagtcgagaggctctaccccatttctttttcaggaggtatgcaaatatgagcatctacgcttttgatattgatattactgggatacttcgtaatcaagaaccttattaccttggggaaccagaagtagtaagtaagttcattaccccatggcaaacagtattcttacctgactgtgaagagtcacacgaggttattggttctcttttcctatccaacctgcaactcaatactaagatactcactgaaccaaaggtgtatgacctctccttttacagcgactttagtatgattttccctggtgttaggttctataaaatacctggttgggaattgatagctgaccataatgtctttaataaaacactttccatttacttcagacctattcctaaaggaaggaaaattaatcatgaaattcataatgaccatccccagttttgctgaaagagaatctatgtatacaactgacttctctttagaagaagtaatgaacagcaacccccagcaagtaatcctggttcctaccttagaggactaccatgaagtaaggggacagctattcttagcaggtaatgatcgtaaggttgtatgtattattccaccctctgtctataccaactacagtgcaggtgaccctatcccatatatgttggtatctaatgactaccaatgggatagtcggtatgtaaatgatgaatactgttactactatataaggaagtaagatatgcatctgtattgccttattagctttgctactacttgctatttgtctccatatacattggataatatcctggcaggtaaggggagagttaccaccatcctgtatgagccaagtgaagatgcagatgtgctcataggtacttgcttaatgttggggcaacctatccaattcattaagatagtagattccgtagaaataccggaacacaccagtgtgtacatattgtcagagagtgaacctatggtagtaactacccttactggtagacttattaccctctatccttctacctcatatttatctagcgacgagagtctctaatgaaactaaacacatcaccctacccggtacagttagaagtagtattcgaccaggataccttcattaaaaagtataagaaacttaaagggcatgagccagacttggatggttgtaaggggtatacttcttattctggcaatcgagtattgattggtatctttagggaacctttacatacactcatccacgaactcaaccatttctgtttgtgggcgtttgactacataggtatgcctataaactctgccaatagtgaagcatattgctattactatgaccacatcctctcccagattccttcctcctatttaactgcttataaggattagcatgagattatatttcctatcagatatgggaaggttacatgtaggagagggtatactatggaattggatatgtaacaatattcccaatgtacctgtatatgttcactccgatatagactatcactggttaagaggcgagtgcttacttagaaatatgatagttaacttcataaaactagaaccatgggatagggtatccgatgtatctggcccatgctacttcttagcagttaatgggcatagagcagagaagatgttatatagaactaaatagagggtagatagataccttctcataatatttataaataaggcagaaccggtgacaagagtacaatacctatgaatcctatagcgaaggcacaggcaataaagtgaagccagttctcagggtctgtaggattgtaattaccccaaccatctttcatgttagtaccccaaagttatctgcttatagagatagtgcctataatatttttgcatgtcaaaattgtgatagctatatacagcagcagtgttg

SEQ ID NO: 23 - DNA, 72689 bp, Unknown; identical to SEQ ID NO: 19
  Podoviridae; G7cvirus

SEQ ID NO: 24 - DNA, 43964 bp, Unknown
  Podoviridae; Autographivirinae
tctgttcgtttcgttcactccgcttgcgctacgttcactcgctcacgggtaccttaggttattccttgatggatggcttaggttagccttagtggcctaccttagttataaccttagtgcatagcttagtatcagcttagtagtgtaccttagtaagtcttagtgtcttctcttagtgattgcacatgcaagcatgtaagatgccattaggtcgcggtcggtagaccgctaaagaaagagaatagtaataagatgcagtaggaggaacaccagaagcctagccaacctaagctatcctagccttgtatctattgcttttccttagtctcacatgttagacaacctatcttattcttagtgatgataacttagtgttgacaagataatcttagtgtaatactatgcatcacgtaggcggtgctgaagcacctagtagccagctagtaaggcatacgaagagactagcgcttacattgctctttaacaatttgcttagtgtaacctatgtatgccgtggtcaactacttattgaatgaggaattaactatgacattaaacaaccgtgaactgtccgttctcttcactctgttgtgctacatgattcgtaacaacgaattacttacagacgatgagttagccttgtatcaccgctttcttaacgaaggttggaccgatacagttaatcaataccgtaacatgatagatgagttgagggagggtaaataatgtatcagcatgaggttttctttgagtcagccagtgaagctatccgcttccatgatgatatgatgcaagctggcgtaggtgttgatgtatatcactatttgatagattacgacactgaatatcaccgagttaccttagtatctgagtatgacaaccaagtcattactgagtatctaggcagtgaagattacgattacgatgaagtaataacgacaaatctctaaattaactgttgacagccacggcatacaaggttacattaagcatcaagacggcgacgtctttaaacatcccgctctttaacaatacggtttgtgtcttgataggctaactaactaactaaggtaattatcatgaaagggttaatttgtgtagaacgtatggtcaatggtaaacttgaaatattaccactggaaaaccaatctagcttcaaagagtggtatggctgtttctcactgatttaaggtaaaggctggcactagtcagcctatcaaggcgcaaaccaagctctttaacaatttggatggtagcttcttagtctggataggttaaacctaggagattctcttgagtctcctataatgtaacctaactaactaaatgaggattaaatcatggaacgcaatgctaacgcttactacaaccttctggctgcaactgttgaagcattcaacgagcgtattcagtttgatgagattcgcgaaggtgatgattactctgatgcactacatgaggttgtagacagcaatgttccagtttattacagcgaaatctttacagtgatggctgctgatggtattgatgttgattttgaggatgctggtttgattcctgacacgaaggatgtaaccaagattctacaagctcgcatctatgaagctctttataatgatgtaccaaatgacagcgatgtagtttggtgtgaaggcgaagaagaggaagaataaggatggaaaagcaatataactttatcttttcagacggtgtaaccctgaagtgttccctacgattcgcacaaattcgtgaggaagtactaggcactacatacaaactatttagctgacactataagagaaggcttaacaaggcgttactaaggtagcgcctgattaaactttcacttactaggagttgagattatgaaaaccttgattggatgcttcttgttggcttctcttgctctggcatttaccgctaaagctggttatgatgcttataaagtagaacaagcccagcaagactgggccaaaaagttcaacttgtgcagcaagagcaacacctacgagtactgcaacaaaacactaagacacttatggaaagagtaactagcctatagcccacctgagtgggctatgtgatatttacttaccactatataaggcgattactatgactactgaaaacaccctcgtgtctgtccgtgaagctgcaaccgctgaaatcaagcaacatttagacaatatcggcacttcttacatcaaagtaggggcttgtctgaatgagttacgcggagactttgaaggtcaaaaagagtttttagcctatgttgaagcagagtttgccattaagaaggcacaatgttacaagctgatgagtgtagcccgtgtctttgaaggcgatgatcgctttaaaggcgtggcgatgcgtgtaatgctggcgcttgttcctttcgctgatgaaaatataatcatggagaaggccgcagaactcgccgcaaatggcaagctggacactaatgccgtaaacgccctgattgaacctaagaaagagtcaaaggccgaaacggtacaatctaaggctgagacagtaaaaccgcaggagaacgcgactgagtccgcagaatcacatgaaatgcaagcgccgcaggtagtgccacccgcgagcgagcaggagtccgacgaatcagcaccttgggaagaggaaagcaaaccggaagcgccaaaggcagctccgatggataacacggctaatactgagaatgccgctattgctggtctgctggcacaaattaaagcactgactgagcaattacaggcagccaatgaccgcatcgcctccttaagtagcgcacgcgaaagcaagaaggcatccgcacctatgctgccgcagttcaaatcttcctgcttctacgctcgcttaggcttgagcgcggaggaggcaacgaagaaaacagcagttaacaaggcacgccgcgaactggttaagctgggatacggtgaaggccatgaggcatggcccttaatctctgaggcagtagaagagttgactaagtaaccttatcggtggcatcttcttaggtgtcacctattaaggtttctttcactaggagtaaacaagatgcaagacctacacgctattcaacttcaacttgaagaagaaatgtttaacggcggtatccgtcgctttgaagcggaccaacaacgccagattgcatccggtaatgaatcagacacggcatggaatcgccgcttattgtccgagttaatcgcgccaatggctgaaggtattcaggcatacaaggaagagtatgaaggtaaaagaggccgtgcaccgcgtgcattagctttcattaactgcgtagaaaacgaagtggcagcatatatcacgatgaaaatcgttatggatatgctgaacacggatgtaaccttgcaggctatagccatgaatgtagctgaccgcattgaggaccaagtacgttttagcaagctggaaggtcacgccgccaaatactttgaaaaagttaagaagtcacttaaggcaagtaagactaaatcatatcgccatgcgcacaacgtagcggtagtggctgagaagtcagtagctgaccgtgacgctgatttctcccgctgggaggcatggcctaaagacacattactgcaaattgggatgaccttgcttgaaatcttagagaatagcgtgttcttcaacgggcaacctgtcttcctccgcaccttgcgcactaatggtggcaagcatggtgtttactacttacagaccagtgagcacgtaggggagtggattacagcatttaaagaacatgtagcgcaacttagtccagcatatgctccttgcgtcatccctccgcgtccgtgggtatcaccttttaacggcggtttccacactgagaaagtagcaagccgtattcgtctggtaaaaggaaaccgcgaacacgtccgcaagctgaccaaaaagcaaatgccagcggtttacaaggctgttaacgctttgcaggcgactaagtggcaggttaataaagaggttttacaggttgtggaggacgttatacgtctagacctcggctatggtgtaccttcctttaaaccactcatcgaccgtgagaacaagccagctaatccggtgccgttagagttccagcacctgcgaggccgtgaactgaaagaaatgcttacgccggaacaatggcaagcctttatcaactggaaaggtgaatgtactaagctgtacaccgctgaaactaagcgcggaagcaaatcggcggcaaccgttcgcatggttggtcaggcccgtaaatatagccagttcgacgcaatctacttcgtgtatgcactggacagccgcagccgcgtctacgcgcaatctagcacactctcaccgcaatcaaatgacttgggcaaggccttgctccgttttaccgaagggcagcgtcttgatagcgctgaggcgcttaagtggtttttggtgaacggggctaataactggggttgggataagaaaacttttgacgtgcgcaccgctaacgtgctggatagcgaatttcaagacatgtgccgcgacattgcagcggatccgctgaccttcactcaatgggtaaatgccgactccccttacggcttccttgcatggtgctttgaatatgcgcgttatctggatgcactggatgaaggcacgcaagaccaattcatgacgcacctcccagtccatcaagatggtagttgttctggtatccagcactacagtgctatgctacgcgatgcagtaggtgcgaaagcagtaaaccttaagccctctgactctcctcaagatatttatggtgccgttgcgcaggtagtaattcagaagaattatgcatacatgaatgcagaggatgcggaaaccttcacttctggcagcgtgactttaacaggtgcagaactgcgtagcatggctagtgcgtgggatatgataggaatcactcgcggcctgaccaaaaagcccgtaatgacactaccttatggcagcacacgtctaacctgccgtgaatcagtgattgattatatcgttgatttggaagaaaaagaggcccaacgggctattgcggaagggcgtaccgccaatcctgtacacccttttgataatgaccgtaaagacagcctgacacctagcgcagcttataactatatgacagctttaatctggccttctatttcggaagtggttaaagctcctatagtggcaatgaaaatgattcgtcagcttgcccgtttcgcagctaaaaggaatgaaggcttagagtacaccctgcctactggcttcatcttgcaacaaaagattatggctactgatatgctccgcgtatctacttgcttgatgggagaaatcaagatgagtctacagattgaaacggacgtagtggatgaaacggctatgatgggcgctgctgctcctaactttgtgcatggtcatgatgccagccaccttatcctaacagtctgcgaccttgttgataaagggattacatctatcgcagttattcatgactcttttggcactcatgcaggccgtacagccgaccttcgtgatagcttaagggcagaaatggtgaagatgtatcaaggccgtaatgcactgcaaagcctgctagatgagcacgaagaacgctggttagttgataccggaatacaagtaccagagcaaggggagtttgaccttaacgaaatcttagtttcagactattgcttcgcataatattaataggccattccttcgggagtggcctttcttttacctactacctgtaacatttcattaacataaagtgtctcacatgtgagacttatttaccggacactataggatagccgtcggagacgggaaagaaagggaagataaagggtataaaggaagtaataggtattaaaggttatataggttatataggaatacctattaccttcttccttcctcttattaccacttagaggaagggcagacctaggttgtctcacatgtgagacttcgtatttaccggacagtatagataagattaactcactttggagatttaaccatgcgtaactttgagaagatggcccgtaaagctaaccgttttgacatggaagaagggcagaagaaaggcaagaagctgaataaacctgtccgtgaccgtgcatctaaacgcgcagcgtgggagttctaagttatggctattattcagaatgtaccgtgtcctgcttgccaaaagaacggacatgatattactggcaatcatttaatgatctttgacgacggggcaggatactgtaaccgtggtcacttccatgataatggcagaccctactaccataagccggaaggtggcatcgagataacagagttacctattactggcaatatcaaatatacaccttctcaattcaaagaaatggagaaggaagggaagataagcgaccctaaattacgcgccatcgcacttggtggtatgcgtatgaaagaccgttgggaggtcatgaatgaacaagaaagggcagagcaagaagcagagtggaaacttgatgttgaatggttcctcacgcttaagcgtaagaaccttgtttccagacacattcgcggcgacatttgcgcattgtatgatgtacgtgttgggcacgatgaagagggtagagtctcacggcattactatccgcgcttcgaaaaaggtgagctagtaggcgctaagtgtcgcacattacctaaagattttaagtttggtcatttaggtaaactctttggtatgcaagatcttttcggtatgaatactttgtctcacgtgttagacaagggaagacgaaaggattgcttgctcattgtcggcggcgaactggatgcactagcagcgcagcagatgctccttgattctgccaagggtactaagtgggaaggccagccataccatgtatggtctgtcaacaaaggcgagtcttgccttgaagagatagtgcagaaccgtgagcatatcgcccaattcaagaagattatatggggttttgatggagatgaggtagggcagaagcagaatcagcaagcggctcgcctgtttcctggtaaatcctatatccttgaatacccctctggttgcaaagatgctaacaaggcattgatggctggcaaggctaaagaatttgtagatgcatggtttaatgccaagtcatctgatgaagtctttggtagccagattaaatctatcgcatctcaaagggataagctcaaggctgcacgtccagagcaaggactatcatggccttggcctaagctgaacaaggtaacgctaggtattcgtaagaaccagcttatcattgtaggtgcagggtctggtgtaggtaagactgagttccttcgtgaagtagttaagcacctcattgaagaacacggtgaatctgtgggcatcatttctacagaagacccgatggtcaaggtgtcccgtgcttttatcggcaagtggattgataagcgtattgagttacctccaaccaacgacccgaaagaagacggataccgtgaggtgttcgactataccgaggaagaagctaacgccgccattgattatgtagctgatacaggtaagctgtttgtagctgacctagagggtgactattcgatggaaaaggtagagcaaacttgcctagagtttgaggctatgggtatttctaatatcatcattgataacttaacggggattaaattagatgagcgtgcttttggtgggaaggttggtgcacttgatgaatgcgtcaagcggattggtactatcaaagaccgacacccggttactatattccttgtatcacaccttacacgtcctccggcaaaccgtacccaacacgaagaaggtggcgaagttatcctttctgacttccgaggctcaggcgctatcggattctgggcatcttacgccttggggattgagcgtaatacaagagctgaaacgcttgacgaaaggactaccacgtacatctcatgtgtcaaagaccgcgaccaaggtatctacactggaaccaaggtcatgcttaagggtgacattcaaaccggacgtttaatggaaccacaagcccgtactaagtcatttgatacaggtgaagcaaggcaacaagaagtaccagatttaccggacactatagaagagactaacttcgatgaagaaagtgagttctgattagtgtatttatcagggcttgtctcacatgtgagacaggctcttattaagtacattaaataactggagattgattatgtataacttagtgttgaatgtaggtgactttgtacgcaacatcaagaaagattcaagtcgctatctttgccgtggtgttgtaacctttgtaggtgagaacctgtattatgtagaatatcgcagtggtgttaagcaatattaccacaagaagacagcacataaatatcttgaaaagattgtagagataaacaatcaatgtaagtgcatacatgatgaggtttgcgataaatgtgctcgccagatgcttaagaatttcctagctcctctttattatggtgctggtcctcaaacactagcagagtacatggcagaaaagaaaaccacactcaagaaagagcgtcgcaatgtaatcactggtaagactcaaagtgagatgattaagcaatgtggcactgcattaggtgttacacagtttaatactcgtgcattgggtaaatccacaggacaagctatggtaaagattggagaagccatgatgcatccaaatgtacctgtgcgaatcatggatgttgaccatgcaatcacagaacaaggtacgcaacgacgtgtaattaataagcattttgccgacactatagaaggtattattcgtaagcaagggttgaaaggtcttcacatcttaaatggtgaagaattactgtacctacctatcgttactgaagaaacatacgtgaatatctaaggagttaatcatgactaaggtattaatttatatgcgtggacctcataaatgctatgcagttgtagcaccaaatggtgttaagccttatcgtacttcaaaaagattggcattaataggtgctagtagtagtgcaagtttccaaatggaactttttggtcattggacggaaaggcaattccgtgaggattttaaagtcattggcagcttcatggtgaaatatgcagaataaacatagtcttaaaatgttcgatggtcatgaagacctgcaagccaagattactaaccaagccttcctgttcgctcaggtaactatggctgaggccaagaagaatagtctcactcgtgaacaggttatcaaggaaagtgaagtgaaacgtaagattcgcagtcgataagtcaagggttgtctcacgtgtgagacagcctttcatcatattgattggaggtgcattatgccacgtgattatgattctgattgggactattatgactcaatgaatccaaaacccgaacgttcagatgattactacgaaacagaggcaatgtatgaagactattgattggaagaaggaggcagaaggtcgtatcctcgtgatggatgcggaagctaaaggactccttgacgccatccgatatggacaccgtgaagatgtgcatatcatttgctgcatggacttgcttactaccgaggagtttctcttctttgacccgtatgagatgcgtgaccctgaagcaagagaacgcctgaaggaatgggaaggtcatcaagatggaaccttggttgacggtgttagcttcctgaagcactgtgaggctattgtgtcgcagaacttcctagggtatgacggtcttctctttgagaaagcattccctgatatttggaaaggctttaactataccgagaagcgcggcaagggcagactccgtgctgacctgtgtccggtgcgagtcatggatacgctggtgatgagtcgcctgttaaaccccgatagacgccttcctccgcaagcatatgccaaaggtatgggtaacgtcgcccctcactcaattgaggcgcacggcatccgtataggccgctataaaccggagaacgaggactggtctaaactaactgaccacatggttcaccgtgtacgtgaggacgtggcgattggtcgtgacttgttcctctggctctttaacggggaatggatggagcacaaacgccgtggcgtgaataaacgcactggcctaggtattgagacagccttccacatggagtccattgtggcgctggagatgagccgtcaggccgagcgtggattccgtctggatatagataaagcattagcacgatgcgaggaattggacgctaagattgatgagacagtcgcagcgttccgtccgcacatgcctatgcgtatcaagtctaaaccttttaaaccggaagaaaagaatgaagtatgccaacgcgcaaatgagtatggagctagcaacaatatacctactgtccttgacccctcacactttcttcatgccgagagacgaggagatcgcaagacagtatggagtgtcactactaagtctggtgattggtcggctagtgtcaagaaagactttcctcaccttagaggaaaccgtaatgacacgccaagcatcaagtggattggcgcttactcgcctgttactttcgaagagattcccttgggtaacagggatacagttaagcaagtgctctatgattatggatggaaaggtgttgaatttaacgataccgagcaagcgcatctcgatgagcacggagtgttacccaaaccttggagtggtaagataaatgaaaagtcccttactttatggcaagaaagagccgcacgtgaaggtaaaacagtccctgattggtgcttgggtatcgctgcatggtacatactcgtatcccgtcgtggtcagatcctcaaccgtggtgacgttgaagccttcgaccagaagggggtgtggccttcgcaagctggtacacgaaagtgtcgcggccttgtacctgtagcatttaacaaggagttaggaatcaatgctcagcaatactacgaaaggtacggatgctggcctacgtcagacaaggatgacggagaatggcgtgtgccagctattgctattagtattggaacttctacgttccgtatgcgtcatcgtaacgtggttaatattcctgcccgtggtttgtatcctttacgtgatttattcatagccggtaaaggtaagctaatccttggttgtgatggtgctggtcttgaactacgtgtactgtctcacttcatgaatgaccctgaataccaagatattgtactgcatggtgacattcacacccataatcaaatgaaggctggtcttcctaagcgtgacatggcgaagacatttatatatgccttcctatatgggtctggtatagctaaccttgcagcagtatgtggtgttactgaggaagaaatggaggaagttgtggcaagatttgaggttgaactaccatctcttgcacgtcttcgtgagaatgttatcgcacaaggtaacaagtttggctacctacaagcacctgatggtcattggggtcgcatccgcatgtctggtggtgaacttaaagaacacactatgcttaacgtactactccagatgactggttctctgtgtatgaaatacgcattggtcagagcgtttgcagtgatgcgcaaggaaggtgtggccttagatagcatgggaaacccttgcggtatagctaacgtgcacgatgaaatccagatggaagtccctgaagatgaggtcttgtatctcaactacgacttgcctttcaccttagaagggttcgaaacagagaaggctgctgtgaaagcagtgttcgatgcagaggagaaacgtgttcatgtggattctgaaggacgtatgtggtctgctgcaaatctcgttagtattgatgctgatgctggtgtacttcattgccagcgtcgttatcaccgtgcagggcatatcattgccgacgcaatgacctgggcgggtcagtacctgaagatgcgttgtccgatggcaggtgagtataagattggtgcaagttggaaggaaacacactgatggacaggtttgatattgtttgcctattctctaccttctttcttatattccttatgcttgcttgctatggaagtatgcgattagatatacctgatgaagaggagggttacgattgatgcaggcatcttttattattcttggagtcatattatttatggtagtattctgggctttctctggcattgacccagattgtgatggtaactacgactgagttatactcaaggtcacttacgagtggcctttatgaataacttattcctacttattttgtctaacatgatttactggacactatagaaggaaagcataggtaatctaggttataaggtagtataggtaattaagtaaatataggagatataaatatgtctatggtaactactctggtattcgtggctcaatactttcgtggtcttgctaataagttcaagtccaaggctatcaaagctattgaggctcgcatcgaagcagtacaggcagagcaagttaaagttgaagaacatcgtagttctcaaatgattgactgtcataaccgctactatgcatctcgtgatgaactaaatgcacgtcaagtcaaagaggtagaagatatgctggcacgtcaccagcaagagcgtgacagcctgaaagctgaatttgaagagaacaaggcatcaattgcccttgtacatcaagctgcatctgacagtctgaagaaagagattgttatgctggaaatcgaactggataacctgaccaaataaggggttatgatggaagaagtaattcaagctaaacatgtaggtattatctttcgcgatctagagcagcgtaaagttgcaggtcatactcgtctggctaaagaggaagacaccgcaatcactactgtagaacaagcagatgcctatcgtggaccagagttcactcaaggtgaaacttgtcaccaattgagcctgtcaatttgtgacactatggctattgtaaatgtgcaagaagtcgaagagggtgagtgtgtcagttacatctaccctttagatactattgcacgcattaaggtaatccataagtaattactagacactatagaacaataggtcggcttagttcggcctatgattgtgtagtgtaacaataggagactaaataaatggcacgtggtgattttgattttggtgctcagattactaaatctgaaggtaaagtctttaagaatccagaagtaggtgatcatgaagcagtaatctctggcatcattcatgttggttccttccaagacatctttaagaaaggcaataccactgaagttaagaagccagcaaactttgttctggttaagattgtcctgatgggcgacgatgataagaacgaagatgattctcgcatggaacaatggatggctgtgcctctgaagtctggtgataaggcaacactgactaagttcctgaatgcagttgaccctaaagagttgctgggtggcttcgatgatttcattggtgaatgcctgactgcaacgatggttggttctggtgacaagaatgaagatggctcattcaagtatgttaactggaagggatttggtggtatgccggacaagctgaagaaactggtcattgctcaggttgaagaggaaggtctgtctatgacaggtcacattaccttcgacaagctgaccaaagaaatccttgatgacatcccagccaacttggtgcgtcaatacttcctgaacgagacgcctcgtggtaagaacctgtctgttgctggctctcatgtagaagcaataattaaagctgctcgtgaagaagacccagagtggaagaaggctaagaagaaagatgacgaggatgctactccagctaatcgtaaatctctggatactggagagtctgttccacaggaagtacctgaagcagaagatactcctgcaccggagatggatgaggacgcggaatattaaggagaaaggatgaaagtacaaatcgtaaccctgcactgcaagaaaggtatcacaacgctaggaggtggcactttccactctttctccgaaggggagatttatgctgacctgcactacatctggcgcgacggacagcacgtggtgaactacagcgacccagctacggggaaacgccacggcgtatcgcttccggcgcatgacattgctcaggtgaacacagttttataaagtctcacgtgtgagacaaatcggtgtccggtatttactggacactatagaagagaagaattttaatcggcgataatgccataaccaacaaaaggagaatttaatatgttcaagattgaaactatcgtaaaccgtgttgttaaaggtgctgctctggtatccgttgagtctttcattatcgtcgatgaaactgatcaactggtagctggtactaaggcttacgatacccgtgaagaagctcaggctaagattgacagcatgggtaacttcgctgctggtctggagttcgctcgtgcctgcttccctgagcaggctgacaaagcccagatcgggaaggctaacatcgtagctgaatatctggattgggttgctgctggtaaaccagtgaaagaagttaaggctgctgaagaagctgaagctacggcagtagaagtagctgcaccggaagctccggtaagcgaagaggaagaattttgataatagcaggtgttgcctctgttagtcctagctgactatcacgctcacctcatccaatgccctgtctgccttagtgtaggcagggtcttttgcgtaatagttattggagaatgaattatgccgactattgaatctcgaattgaactggacattagctacaatgcaatcaccagacagtatattggggttgcctatgattacaaaactggtgagaagctagtggaggtgagacaatgggatgactattggttaagacagaacctccatgatgcggtgtcctccttcctgaaggagtggcctacatgcgaccaaacttcgacttcggagctacagtatcggaagacaataacctgttgctgtggccaactgaaggtaatcgaatcgctttaatagatgctgatatgttaccttacatcgtagggtatacaatcagtaatatgacttatgtacgagccacaactcgtgttaagtcagggcaagtcccctcaatcaaagatacacctgagtgtaagcaagcgtgtgaccgtgtgaactccttgcttaactcttgggtgtatgcagcagaatgtgatgcagctaagttattcatgacgaaatcagaagctaacttccgtgtccgcctagcattcaccaaaccttataagggtcaacgtaagaccgagaagcctccgttcttctatgaattgcgagagcatctcttagaggttcatggtgcaatcttggcagatggggaagaggctgatgacctcatgagcatcgcacaatgggacagccaccgccgcttccagcaagatacaggtaacgagttccctatcggtagtccagagcataaagcattctctgatacttgcatcgtttccttggataaggatttgatgattgttcccggttggcatcttcagcctggacaagagaagaaatgggtagagcctatgggttggcttgagttacgccgtaaggctaatggtcaggttaaagaccttaaaggtgctggcctcatgtttcattatgcacagatgattatcggtgatgatattgataactatgctggcatacctggacgtggtgctaaatacgcctatgaccttctcaaagattgtaagacagagaaagagttgtacatggcagtgcttggtgcttacaaggctaagttcggacatggacaagttaagattaagaattaccgaggtggttatcgtatcggcaaggcttttgacctgatgctcgaatgtggtcgcctagctcacatggcaagattcaaaggtgatatatggcgagccgataagaacccaatcttgtggggagatgatgcggaatggttagcaaattaaaatcatcggaggtagcagcttataagagggaattgctagagaagcaaggatggaagtgccccctatgtggcggcagtctcaaggctgttacccctataaaccgtgtacttgaccatgaccatgagacaggattctgccgtgctgttgtatgccgaggctgcaatggtgcagaaggaaagattaagggtgttatctctggttatggtaaggctggtaacaaccgttacttccagcttcaatggttagagcgactatatgaatactggaagttacatagtacgcctcagacagataagttatatcacaaacaccaaacggaggcagagaagcgcgaggctaagaaccgtaaggcacgccttgcttatgcaagaaagaaggaggttaaagttgggtaagcttcgcagcttgtacaaagactccgaggtacttgatgcaatcgagcaagctaccgacgagaaaggtaatgttaattacaatgagatggcacgtgtattatcgtgtcaccctgtgggtaagaagattacccgccagttggctcgatactggcatggtcaattcaagaagaccaagaagaatggtgattattaccagacccttctgcaagaagataagcgtatcaaagaagagcgtaagctcaggactcctgaccgctacgaggatttggctattgtgccattgcctgactcgcctcatcgaagtgtactggtgatccctgacactcatgcaccttatgagcacccagataccctagagttccttgcagccgtggcagcacgttaccgtccagacacagtggtacacctaggagatgaggcagacaaacatgccctgtcgttccacgattcggacccaaatctggatagtgctggcatggagttagagaaggctcgtatcttcatgcacaaattgcacaagatgttccctgtgatgagactgtgtcactccaaccacggctctatgcacttccgtaaggcaagcgccaagggcatccctgtgcaatacctgcgcacctatcgtgaagtcttcttcccgcagggaggtggcgaccagtgggattggcaacatacgcacgtccttgagttgccgaatggtgaacaagtggcattcaagcatcaacctgctggctctgtcctagcagatgcagcgcatgagcgtatgaaccttgtgtgtggtcacttgcacggtaagatgtctgtggagtacgcacgtaatacacatgaacagtattgggctgtgcaaggtggctgcttaattgatgagtcatcccgtgcatttgcctatggtcgtgagtctaaatacaagccagcattaggttgtgtggtcattctggagggtgtgcctcacattgtcccgatgcaaaccaatagcgacaaccgttggattggcaagatttagttgacactatagaacaaagggctaggtaagactttatcggctggcgtatccaaatgatattgcactagcccttgattgtatagtgaatggaggattcaatatgtcacactatgaatgtaagaagtgtcataagcgttatgattactgtacttgtggtcaagagaaaacatcttttaaagttggagacaaggtatttcgtaatgaaaaagattcgattccttggaatcaatactgcaaagaagctggtattgaccctgatagccctgtaaccatagatgatattgatggcattaacttgtgctttcgtgaggtgaggggtacaggttgggattccaaaaaattcaaacttgcatctgataagttagacaacaatatggtaactaatcctaagcactacgagttctttgatggcgtagaggcaatcactatcattgcccgcagtatgaccgagaagcaattcgctggctattgcatgggtaatgctttgaagtaccgtctacgtgcaggtaagaagttcaacactgaagaagacctgaagaaagcagattactacaaagagttattccagaagcatcgtcacgaatgtattgatgaggatatttgatatgaatatctttgagttcctaggtcttccagaagaccaccgcaatcacccattcatgctggtgaagcatcgcggtgaagttcctgagaagaaattaacttttccatgttatgcacaggtgaaacgagatggtatcttttctgctgttgttgttcgcactgatggtgtcgttggcatttttggtcgcactggtaagaaattggcaaacactgaaggactcgaacaagcctttgctacctttccggttggcatttatcttggtgagcttcagtctatggccattgatatctaccttgaggcaatctctggggttgtgaaccccaatcgcactgagccacttgatttcataggccagcagattaaagacaaactgtatatcgacttcttcgatatgttaactattaaggcattccatgatggattcactgatgtttcttatctcaaacgttacgatgctttacatcgtcgtatcggcgctcatcttagcgggtacaacgctatccttcctattactccttgccataatgagcaagatgttgaagcgtttgcgcaagagcaaatagatgcaggccgagagggtgctgtattcaaactggactgcgattatgaagcaggccacaaaggttatcgtcagactaaagaagtccgtaaggtaacttatgaccttacttgtattggctttgaagaaggtaaaggtaagtacaaaggtaaggtagctaacctcattttcaagtggaaaggaggcaagacaatcaaagcgatgttaggtaaagggtggactcatgcagatgcagaacagatgttccacgacattaaacatggtggacgattgaatgtcattggtaaaatctttgaagtcaaaggtcttcaggattcaagcaagggcaacattcgtctgcccaaagcgggagaattaagacatgacaaagatgaaccagatttcttttgatagcatgaaggcaactcgtgcagttgaggtagcagaagctatctttgaaactttatcctgtggcatggaagtgccatatactttacttgctgatgcagaagaacttggtctttctgtagaagctatccaagagaaggttgacgaattatatggtacagacgaagaagaaaccgacgatttcatttgaaggaatggagatgcttgagatgattctcaagccttcttctccgaaggtgactaagactcatgaagagttaatcgttgatgaagtgaagcgttacatcatggattgtgtcagagcacaactggtggtccaatgatacgtccagcttccttcctagatattcctgagattataaaccttgggaataaatatgtggaagaggaagtcaaggtagtggcccatcactcagcctcatgggatgcagaacaaagcgcacattacctttgcgcatctcttagtagagaagatttattcctatgggttgctgtagatgaagggcggattgtagggttcctgtgggctggctatcacgagttggccccttggacacctgtaagggttgcctctgacattctcttttatattataccagagaagcgaggaaccctacttggtatgcgtctcatcaaagccctaaagcaatgggctagtgataatgaatgctctgaggttcgcctgtctatcgcctctggtattaatgaagaacgtgtcggacgtatgtataagcgacttggctttgaaccgtttggcactgtgtacaacctgaagttctaaggagataacatgggtgttgtaaagaaagcatttaaggctatcggtcttgctcaagatgcaccacgtattgaagccaaagtcccagcacagcagcttgagcgtaagcctgagactgaagctgaagatattcaaattggtgcaggcggtgatgatgcgactgcatctgcaaaaggtaagcgcggccttgtccgtccggtagcttctagcttgaaggtgtaatatgaaacagagcacagatttggagtatggaggtaagcggtctaagatacctaagctatgggagaagttctccactaaacgtagctctttccttgatagggcgaagcattactccaaactaaccttgccctatctgatgaatgacaaaggtgataacgagacttcgcagaatggatggcaaggtgtaggtgctcaggcaactaatcatctagccaacaagctagcgcaagtactattccctgcacagcgttccttcttccgtgtagacttaactgcacaaggtgagaaggttcttaatcagcgtggcctgaagaagacagagctagctaccatcttcgctcaagtggaaacacgggcaatgaaagagttagagcaacgtcaattccggcctgctgtagtggaagcattcaagcatcttattgttgctggtagctgtatgctatacaagccgagcaaaggtgcaatcagtgctatcccaatgcatcactacgtagttaaccgtgataccaatggcgacctgttagacattatcttgctacaagagaaagccttacgtacctttgacccagctacacgtgctgtagtagaggttggcctgaaaggtaagaagtgcaaggaagatgacagcgttaagctgtacacacatgctaagtatcttggtgatggattttgggaactcaagcaatctgctgatgatattcctgtaggtaaggttagtaagatcaaatcagaaaagctacctttcatcccattaacttggaagagaagctatggtgaggattggggtcgccctcttgcagaggattactccggtgacttattcgttatccaattcttatctgaagcagttgcccgtggtgctgcactgatggcagatattaagtacctgattcgtccgggtgctcaaactgatgttgaccactttgttaactctggcactggtgaggttgtcactggtgtagaagaagacatccatattgtacagttaggtaagtacgcagacctcacacctattagcgcggttctagaggtatacactcgccgtatcggtgttgtcttcatgatggagacaatgacacgccgtgacgccgaacgtgttactgctgtagaaatccagcgagatgcgttagagattgagcagaacatgggtggtgtatactccctctttgctactactatgcaatcgccagtagcgatgtggggtctgctggaggcaggggagtccttcactagtgacttagtggaccctgtgattatcacaggtattgaagctttaggacgcatggctgagttggataaactggctaactttgctcagtatatgtcactgccattacaatggcctgagcctgtcctagctgctgtgaaatggcctgactatatggattgggtgcgtggtcaaatctctgctgaactgccgttccttaaatcggctgaagagatggcacaagaacaggaagcacagatgcaagcacagcaagcacagatgcttgaagaaggtgtggctaaggccgtgcctggtgtaattcaacaagaacttaaggaggcgtaatgtctttctcatttactgaaccgtcaaccactcaccctactgctgaagagggtccggtagaaaccaaggaggtaacaactgatgctgctactactgatgctcctgctgacgctggcacttctgtacaagatgacaatgctggtgcacaacctactgaagacaccggaggagaagcttctggacagccttcagaaaaaggagacaatggcggagagaatggtgaacctaagccagatgataccgcgaccgacactgaggaagtgcaatacttcttcggagaacacgaagtaacagtagacatcccacaggatgtaactgacagccttaaagagaaaggcattgatgccaagcaggttgccaaggaactctattccaaaggtggcaagtttgaactgtcagatgcaaccaagcagaaattgtatgatgcttttggcaagtttgcggtagatgcttacctatcaggtctaaaggctcaaaatgaagccttcttcctgaaagaagccaacgcagctaaagagttggaagcagctaacacccaacgcttctctgatgtttctaaggaaattggtggcgaagaaggttggtcccgtcttgaggagtgggcgcttgaaactctatccgatgacgaactcacggcattcaatgcggtgatggagtctggcaaccagtacctccagcagtacgctgtgcgtgaactggagagccgccgtaagcaggcacagggggatgataagccatccctgattgagccatcagcacctgctaaggctaatgaagagaatggcccactgacgcgagatcagtacgttcaagcaatcgcaactcttagccagaagtacggcaatgaccgtaaagctatggcagaagctcaggctaaactggacgcccgtcgccgtgctggcatggctcgcggtatctaattcagtatttactggacactatagaagggagaaaagttctccctagttatcaatttgatttataaggagattataatacatgtctacaccgaatactctgactaacgttgctgtatctgcgtccggtgaggttgacagccttctcattgagaagtttaatggtaaggtcaatgagcagtacctgaaaggtgagaacattctgtcctactttgatgtacaaactgttactggcactaacacagtgagcaacaaatatttgggcgaaactgagttgcaggtgctagcaccgggtcagtctcctaatgccacccctactcaggcggataaaaaccagttggtaattgataccactgtcattgctcgtaacactgtggctcacatccacgatgtacaaggtgacatcgatagtctgaaaccaaaactggctatgaaccaagccaagcaactgaaacgtctggaagaccagatggcaattcagcagatgctgttaggcggtattgctaacaccaaggccaaacgtaacaagccgcgtgttaaagggcatggcttctctatcaacgttaacgtaactgagagtgaagcactggctaaccctcagtatgttatggctgcggtagagtatgctctggagcaacagcttgagcaggaagtggacatctctgatgtagctatcatgatgacgtggaagttcttcaatgctctgcgtgatgcagaccgaattgtagataagacttacactatcagccagtctggtgcaaccattaatggcttcgttctctcttcttataactgccctgtgattccgtctaaccgattccctaccttcgctcagaatcaggctcaccacctgttgtctaatgaagataacggctatcgttatgaccctatcgcagagatgaatggtgcagttgctgttctgttcactgccgacgcactgctggtgggtcgtaccattgaagtgactggtgacatcttctatgagaagaaagagaagacttattacattgacaccttcatggctgagggtgcaatccctgaccgttgggaagcagtgtctgtagttaccactaaacgtaatgcaacttctggtggtgctgctgaaggttctggtgatgatcacgcaaccgtactggctcgtgcacagcgtaaggctgtatatgtcaaaaccgaaggtgctgcggctgcattctctgctgccccagcaggtatccaagcggaagaccttgtagcggcggtacgtgctgtaatggcaaatgacattaagccgactgcaatgaaacctactgagtaacacctatgccctatctaccttgcgtaggtagggttctttttgttaggaggattcatgcctgtaattagacaaaccagtaaattaggacatatgatggaagatgtggccttccagattattgatagtaagctggaagcggtaaacttgtgtatgcgagctattggtcgtgagggtgtggattccctcgactcaggggacttggacgcagaagatgcaagcaaaatgatcgacatcgtatcccagcggttccagtacaacaaaggaggtggctggtggttcaatcgtgaaccaaactggcaacttgcaccagacactaacggtgaagttaatttacctaacaactgcctagcagtattgcagtgttatgctttaggtgaaaagaaagtacctatgactatgcgagcaggtaagctctactctacttggagtcacacctttgatatgcgtaagcatgttaatgctaatggtatgattcgtcttaccttactcaccttactaccctacgagcatctacctacaagtgtaatgcaggctattgcctatcaagctgctgtagagtttattgtgtctaaggatgcagatcagactaagctagccactgcgcagcagatagccactcagcttcttatggatgtacaatctgagcaaatgtcacagaagcgattaaacatgctggtacataaccctactcagcgtcagtttggtatcatggctggtggctctcagaatgtacctgcttactctcattcaccttatgagaattgggcgctccgtccgtgggaggatcgttaatggaagtacaaggttcattaggtagacaaatccaagggattagccagcagccgccagcggtacgcttggatggtcagtgcacagctatggttaatatgatacctgatgtagtgaatggtactcaatcacgcatgggtacaactcatattgcaaagatacttgatgcggggactgatgacatggctactcatcattatcgcagaggtgatggtgatgaagagtatttcttcacgttgaagaaaggacaagttcctgagatatttgataagtatgggcgcaaatgtaatgtgacttcacaagatgcacctatgacctacctctctgaggttgttaatccaagggaagatgtgcaattcatgacgatagctgatgttactttcatgcttaatcgtaggaaagtagttaaagctagtagcaggaagtcacctaaagttggaaacaaagccattgtgttttgtgcgtatggtcaatatggtacatcttattccattgtaattaatggggccaacgctgctagttttaaaacaccggatggtggaagtgcagaccatgttgaacaaattcgaactgaacgtatcacttctgaattgtactctaagttgcagcaatggagcggtgtgagtgactatgaaatacaaagagacggtactagtatatttatcgagagacgggatggtgctagctttacaataacaaccaccgatggtgcaaaaggtaaggacttagtggctatcaagaataaagttagctctactgacctactcccttctcgtgcgcctgctggttataaagtacaagtgtggcctactggcagcaaacctgagtctcgttactggctgcaagctgagcctaaagagggaaaccttgtgtcttggaaagaaacaatagctgctgatgtattacttgggtttgataaaggcacaatgccttacattattgaacgtacagatatcatcaacggcatagctcaattcaagataagacaaggtgattgggaagatcgtaaagtaggggatgacttgactaaccctatgccctcttttattgatgaggaagtaccccagacaataggtggaatgttcatggtgcagaaccgcctatgctttacagcaggtgaagcggttattgcttctcgtacatcatacttcttcgatttctttcgttatacggttatctctgtattggcaactgacccctttgatattttctcagatgctagtgaagtctaccagctaaaacatgcagtgaccttagatggcgctaccgtgttgttctctgataaatcacaattcatactgccaggcgataagcctttagagaagtcaaatgcactgcttaagcctgttacaacatttgaagtgaacaataaagtgaagccagtagtaactggtgaatcggtaatgtttgccactaatgatggttcttactctggtgtacgagagttctatacagactcttatagtgacactaagaaggcacaagcaatcacaagtcatgtgaataaactcatcgaaggtaacattaccaacatggcagcaagcaccaatgtcaacaggttacttgtcactaccgataagtatcgtaacataatctactgctacgattggttatggcaaggaacagaccgtgtacaatcagcatggcatgtatggaagtggcctataggtacaaaggtgcgaggtatgttttattctggtgaattactttacctgctccttgagcgaggagatggcgtgtatctggagaagatggacatgggtgatgcactaacctacggtttgaatgaccgcatcagaatggataggcaagcagagttagtcttcaagcatttcaaagcagaagatgaatgggtatctgagccgctcccttgggttcctactaacccagaacttttagattgcatcttaatcgagggttgggattcgtatattggcggctttttcttattcaagtacaaccctagtgacaatactttgtctacaacctttgatatgtatgatgacagccatgtaaaagcgaaggttattgttggtcagatttaccctcaagagtttgaacctacgcctgtggttatcagagacaatcaagaccgtgtatcctacattgatgtaccagttgtaggattggttcaccttaatcttgacatgtaccccgatttctccgtagaagttaagaatgtgaagagtggtaaagtacgtagagtattagcgtcaaaccgtataggtggtgctctcaataatacagtaggctatgttgaaccgagagaaggtgtcttcagatttccactgagagctaagagcacggatgttgtttatcgtattattgtagagtcacctcacacattccagcttcgcgatattgagtgggaagggagctacaatccaaccaaaaggagggtctaatggctataggttcagccgttatggctggtatgtcttctattggtagcatgtttgcaggcagtggtgcagcagccgctgctggaggtgctgccgcaggtggcggaggtttgctaggttcactaggtggattcctaagtggctctactgctggtttctctaatgctggccttcttggtgctggccttcaagggttaggcttgattggtgatctatttggtggaagtgatgaagccaaggcgatgaagaaagcacaagaagagcaatggcggcagcagcttattgctacacaagaggcgtacaagacagtggcagacgcagaacgttctgctgctaaacaatatcatgcagatgcaatcagtaatcaggtttcactgctacagcagcgagcacaggttgcattacttgctggggctactggtactggtggtaattctgtgtcctctatgcttaatgacttagcagcagatggcggcaggaaccagagtactatcattgataactatgagaatcagaagattaatttcaccaaccagcttaagtctatccaacgtggtggtcagatgcagatgcgtgagtttaagaagccttctgctatgaataccttggttaaaggtattccaagtctggcatctgcctatgtaactggtagtaagtctggcaaggcattgggtaaagccttaactgattctcgcacatattcatctggaacaagaggtatttaatggcaattgagcgacaagcagtacaaggtctgccacaagtgcaggccacttctcctaatgtcatgacctttgcacctcaacaagtgggaggtgtggaggctggcgtggcttctacctccggtagtaggtttatcgaagaccttattcgtgcagcaagcagcgtggctgatgttaccactggtatccttaatcagaagattgaggaagataaggttgttcaaatggaacgggcatataacggattaatgccttctgaggatgcaactcgtggtggcgctcgtgctaacatgcttgtcaaagctcaactgctagctaatgatgaagcagcacgaatgaaagacatggctactcgtttccaaggaacggatgacgaatggacacaacttatggttgactctcgtaatgagatgcagaataagctgttccagcaataccccgagttgcaaggtgacaaagatactatgcgtatggtcactaatgtcttccaagaacagcagcctcagatttgggctacacgaacccagcataaacttgaccgtgaacaagcagaccgtgaggatacctttgacgggcgagtggcttctacttgggattctaatattgaccctgaagcctctggctatgctttacaggaacgaatccgcgaaggtcttactcaaggattactacctgaacagatgtacaagaagttagtccagcgagcaatttcacttgcacaaggcggtgatgttagcatggctgaagccctgaagtatgtgaaggacgataagggtgtttctgtttatgctaagaatccacagcttatcacagccatcactagtggtaatgcagtttgggctaggaataatgtagctgatgtaactcgtatgtctttcgaagttaaagaatcctaccttgcaggtgatttaactgatgaagaattgttggaacgagcacagcacattaataatctgacaggtaactctgtcttctctaatccagaactagaggcactgatgcgccaacgggctaagcagaatgcagagctaggtgcaatgcaggatatgcgacgtgagctttactccgaccgcctgactggcttccaaggtaagactgataaagagaagaaggcttacattgatgttatcaaacaggatagccaactttatgcagaccagcaaatcaaacaacgtggcttggacccttacagtcaagaggctgaagctattcgtggtgcagtggaagtgcagcgcctgcaattcatgaactccaaaggcttagtggatgatacctttgagtctcgtatcaaagccatggaatctatgctatcgcctgagcactttgccaagggcgaaccacaggagttgatgactattcgccagttgtgggaacagttaccagaagagagccgaggtgtctttggtgacacggtgaatggctacatggataactacaacactgcactacaaatgggagagacacctttgcaggctgcaaggtttgcgcgtaaagcacagcagaaattctctcgtactgagaaggaaaccaagaagttcaactcagctattggagatgcactggatgaggtatctggtgctggctggtttgatggtaaaaccgaagtgtcagacttaggtaaagctattgcggaagaagagttacgagctaaggccaatatgttgtggtctagtggtatgcgtaacatggattccatcaagaaggctttaattacttggggcaataaacgctacactcaatcagaggatgcaaagacttccggtggctatttcattaaaggtgattacacttctgcatctgatatgcttatgtcagttgggaaaggcgtaaaccctaccgatgtacctctggcgcttggtaggtatgtagaaacacagatgccagaattgaagaaggagcttcaagagggggaaactaaagatgatatatacattgattacaatgaacagaaaggtactttcgtgattcgtgctggtgcagcaggtcgccctctttctggagtaatccctgtaacctctttagataccacttcactgctagattctgcctatcagaagaaagtagaggaacgagatagaggcgagtatgttcacccgtatcgtacagatattggtgcacaagagcctatgccagctaaaccaactgccaaagatattggtaaatttggactagctaacttcctcatgtcttctgcttttgcttctggtgagaatctgccttctaacttcgagattaactatcgaggtaatatgcaacaattctatgacaagctagctatggatgagaataaagataaagttggctttaataaggcaactggaacctttactccatataaagacgctcgcggtgagtctatcggttacggtcatttcttaacggaagaagagaagcgaaacgggtatattaagattggtgatgaactagttccctatcgagggtctatgtctcagcttacagagagcaaggctcgcgctcttatggagcaagatgctaagaagcatgtgcctcctactcgtgactggaagattccgtttgaccagatgcatcctgcacagcaacgtggcttgatggatttaacctacaatttaggtaaaggtggaatccagaactcaccgcgtgctcttgctgcattcaaagctggtaagcttacggaaggctttatcgaaatgctgggcactgcatcaagtgaaggtaagcgtattcctggcctactgaagcgacgcgctgaggcatacaatatggcatctgctggtggtgtgcctaagattaccgaagtggagactcgtgaagatggctccatgtgggttaggtttggtggacctatgccagcaggttctgtctcggcatggactcataaacgtattggcgcggatggttggtatcaggtttatgaggctgcacctaccaagttagctaaaggttctaaggtaggtaaagttaagttgtagtacctaactcaaggcttgtctcacatgtgagacaggtctttatgataggcactatggaggaattatggaacaagacattaagactaattgggctggatatgtccagtctactcctgagccgttttctattgaggcggctccggtatcggctcctacgatacgccagcgtaatgagttacaagagcaagttcttgaagctaaagctgacgctgatattttaggtgctgtaggtgctgccttccagaatgagtggttggcattcggaggcaagcggtggtatgaccgtgccactgctgatttcacacctcaaccagactttgagatacaacctgagcaacgtgaagcactacgtttcaaatatggtacggatatgatgcagacaatcactgagggtgttcgttctgaggatgaattgaacttccgtattcagaatgctgatgaagaccttgagcgcaataagcgcattgctcaggctggctgggttggctctgtggcgacgattggcgctgctgtgcttgaccctgtgggatgggttgtctctattccaaccggtggtgccgctaaagttggactcgtaggccgtgctgtgtgtggcgctatcgccgctggcgtgagtaatgccgctattgaatccgtattggtccaaggtgacatgactcgtgatttagatgacattatggtagcactaggttccggtatggctatgggtggcattattggcgctgtagcgcgtggtagggccactaagctcagtgagcaaggggatgacagggctgcgagcattgtgcgcagtgcagacgcaggggaccgctatgtgcgtgctgttgctgatgatagtatcggtgcgatgcgtgttaagggtgaagaggtactcactgagggtgcatttgatatctctagcaaaggtgaagatttgctgaaaaccctacagcgggaaggtaatgcaattgatatgacccctcgccgctgggccggaactctgtctgcccttggtactgtcgtacattcctctcaggatgcaagtgtacgcggccttggtgctcgcctgtttgagtccccccaaggcttaggtatgcagaaggcatctgctagtctcatgcagaatactaacttgaaccgtctgaaatctgctgatatgaatcgtttcaacgatgggttcgatttatggctcaaagagaataatatcaacccggttgcaggtcatactaactctcactatgtgcagcaatataatgagaaggtatgggaagctgtacgcatcggtatggatgagtctacgcctaagtctatccgtatggcagcagaggggcagcaagctatgtatcgtgaagcattagcattacgtcaacgctctggtgaagcgggatttgaaaaggtaaaagccgacaacaaatatatgcctgatatctttgatagtatgaaagccagacgtcaattcgatatgcacgataaagaagacatcatcgaacttttctctcgtgcctaccagaatggcgctcgtaagatcccaaaggaagcagcagatgagattgcacgagcacaggtaaatcgcgttgctgatgctaccttaactggaaagcttagttttgaaaaggcaatgtcaggtcagactaaggcagagtatgaagctatcatgcgtaaggcaggcttcagtgatgaagaaattgaaaagatgatagaagctctggataacaaagaaaccagagataacatctctaaccgagctaaaatgagtttaggattagatgttactcaagaatacaatggcattcgtatgcgtgacttcatgaataccaacgtggaagagctaacagataactatatgaaggaagcagcaggtggcgctgcattggctcgccaaggcttctctacctatcaggctgcacttaatgcaattgaccttgtagagcgaaatgcacgaaacgcggctaaggatagcaaggctagtttggcattagatgaagagattcgtcagatgcgagaaggtcttcgcctgattatgggcaagtcgattgatgcagacccacaggctatatctactaagatgatgcgtcgtggtcgtgatatcacaggtgtgcttcgcttaggtcaaatgggcttcgcacagctaggtgaacttgccaactttatgggtgaatttggtattgctgcaactactatggctttaggtaagcaattccgcttcacctctaaggcgttgcgtaatggcgatggcttcttccgagataagaacttagctgaggttgagagaatggtggggtacattggtgaggataactggctaacaactaagggtgcacgtcctgatgaatttggtgatgtaaccacagtaagagggatgatggctcactttgaccaatccatgaactcaatacgtcgtgctcaaaccaacctatcactcttccgcatggcacagggttctctggagcgaatgactaataggcaaatagctttgtctttcattgaccaccttgaaggcaagaagattattcctcagaagaaactggaggaacttggtcttactcaggagttcatgactaacctacagaagcactatgatgctaactctaaaggttctggcttgcttggctttgatacaatgccttatgccatgggtgaaactttagctaatgctattcgtcgtaagtcaggtctaattatccaacgtaacttcattggtgatgaaggtatctggatgaacaaagcactaggtaagacatttgcacagcttaagtcattctctcttgtatctggtgagaagcaatttggtcgagggattcgccacgataaaattggtcttgctaagaagacagcttacgggtttgctttgggttcaatagtgtatgcggcaaaagcctatgtgaactctattgggcgagaagaccaagatgaatatttggaagagaagttatcgcctaaagggttggcctttggtgcaatgggtatgatgagtacaactgctgtatttagtctaggtggagatttcttaggtggcctaggtgttctaccttccgaactcattcaatcacgctatgaagcaggtttccaaagtaagggtctgattgaccaaatacctctggttggcgttggtgcagatgcagtaaatctggctaactcaatcaagaagtatgcagaaggtgacacagaaggtgtagatatcgctaagcgagcactccgtcttgtgccacttaccaatataataggtgtccaaaacgcattgcgttatggcttagatgaactggaggattgatgagttatactttcacagaacatacagccaatggcacgcaagtcacctatccctttagctttgctggtagggataaaggttatcttcgtgcctcagatgtgatagtggagtctcttcaaggtaacacttggattgaagttacatctggatggcaactaactggcacgcaccagattacttttgatgtagcaccagttgcaggtttgaagttccgtattcgaagggaagtacaaaaggaatatccatacgctgagtttgaccgtggtgttaccttggatatgaagtctttaaatggttctttcattcatatactggagattacacaggagttacttgacgggttttatccagaaggatacttcattaaacagaatgtaagctggggcggcaataagattactgatttggctgatggcacaaatccgggagatgcagtaaataaagggcagcttgatgccattgacaagaagcatacagattggaacgccaaacaggacattgagattgctggccttaaggctggtatgacttctggtattgcgcacagaactgttccttggtacacgatagcccaaggtggtgagatttccgtaaacccaccttatgaatttcaagatgcactagttttccttaatggggtattgcagcaccaaattgtaggcgcatactctataagcaacaacactatcactttcgcagagccgcttgtggcgggtacagaggtgtatgtgctgattggtagtcgtgtggctacatctgaacctaatattcagttggagttgaactttgacttagtagaaggccaacaagtagtacagattggctctgcatttaagtacattgaggtctaccttgatggattattacaacctaaacttgcttatcaggtagacggtgacattgttactttctcagaaagagtaccagaatgccggatgactgctaagattatcacagcataaggaggtgggatgattaactccgaactggtagatagtggtgtgaagcttgcgccacctgcactcgtatcaggtgggtacttcctcggtatcagttgggataattgggtgttaatagcaacattcatttataccgtgttgcaaattggggactggttttataataagttcaagatttggagggagaagcgtgagcgtacacaataaacatgcagctacagaggacgaggttggcattctgcatggtgctattaccaaaatcttcaataagaaagcacaggcaatactggacactatagaagaagaccctgatgcagcattacatttagtgtctggtaaggatattggtgcgatgtgtaagtgggttcttgataacggcattaccgccacacctgctgcacagcaggaagagtccaagttatctaagcgcctcaaggctatccgagaggcatccagtggtaagataattcaattcactaaggaggattgatggctaaggcaagagaatcacaagcggaggctcttgccagatgggagatgctacaggagttacagcagacctttccttacacagcggaaggtttgcttctctttgcagatacagttattcataacttaattgcaggcaaccctcatctgattcgtatgcaggcggatatcttgaagttcctattctacggacacaagtaccgcctcatcgaagcgcctcgtggtatcgctaagacaacactatcagcaatctatacggtattccgtattattcatgaaccgcataagcgtatcatggttgtgtcccaaaacgccaagcgagcagaggaaatcgcaggttgggtagttaaaatcttccgtggcttagactttcttgagtttatgctgccggatatctacgctggggaccgtgcatccgttaaggcgtttgagattcattacaccctacgtggtagtgataagtctccttctgtatcctgttactcaatcgaagcaggtatgcagggtgctcgtgctgatattattctagcggatgacgtagagtcgatgcagaatgctcgtacggcagcgggccgtgccttgcttgaggaactgactaaggagtttgaatctatcaaccagtttggggatatcatttaccttggtacacctcagaacgtaaactctatctacaacaacctacctgctcgtggttactctgttcgtatctggactgcgcgttacccttcagtagagcaagagcaatgttatggcgacttccttgcacctatgattgttcaagatatgaaggacaacccagcacttcgctcagggtacgggttggatggtaatagtggtgcaccttgtgcccctgaaatgtatgatgatgaagtcctgattgagaaggaaatctctcagggtgctgctaagttccagcttcagttcatgcttaacactcgcatgatggatgctgacagatacccattacgcctgaacaatctaatcttcacctcgtttggtacagaggaagtccctgtgatgcctacgtggagtaatgattccataaacatcattggtgatgcacctaagtatggtaacaagcctacggatttcatgtacagacctgtagctcgcccatacgaatggggtgctgtctcccgcaagattatgtatattgaccctgcgggtggcggtaagaatggggatgagacgggtgtagccatcgtattcctgcacggtacattcatttatgtgtatcagtgctttggtgtacctggcggataccgagaatcgtccctgaatcgcattgtgcaggccgcaaagcaggctggtgttaaagaggtattcattgagaagaactttggtcatggcgcgtttgaggcggtaattaagccgtactttgaacgagagtggcctgtaactctggaagaggattacgccaccggacagaaagagttgcgtatcattgagacgctggagccgctcatggcagcccataggcttatcttcaatgcagagatggtgaagtcagactttgagtcggtacagcactatccgcttgaactacgcatgtcctacagtcttttcaatcaaatgtcgaacataacgattgagaagaacagcctccggcacgatgaccgcctagacgccctgtatggcgctatacggcaattaacttctcagatagactatgacgaggttacacggattaatcgcctcagagcgcaggagatgcgcgattacatccatgctatgaatacacctcatctacgcagggcaatgctatatggagattacggtactgagcgaagagtgaccaacacttccgtagcgatgcagcagcgagtttacgggcagaactaccgaaataaatcggcaagcagaaatacactttctgcaaggatttcaaggacttattaattactggacactatagaaggaaggcccagataataagagaaaataataggtaatatataggttaacctaggttatataggtatgccttagtatgggtgtactcctgtacaccctattccttactaccttactatatttacataataggagagagacaatggctaatgattatagtcgtcaaccattaacaggtaaatctaagagaaagcaggtacaacctgtaagtgaagaactaatgcttccggtaatcccaaaagaggcagctagtaagaaaagcaatgttattaatgatgccaccaaatcaggtaaacagaaaggggccatggtgtgccttgaagtggaagatggtgtattgaagattgctatcgcggttgatggcaaagaagattcagagtggaagttagtgacagtggaacccactgttaccccagcttaagagaaggaggatgttacatggctaaatatggtactacaggttctgttactggtcaggcttttcgagtaaaagcagtacaaactattgcaacggcaatcccgatgcctgttgttaaagaagcagaccttaagagtaaagaccaccctatcaacatcaaacatttatcaggtaaacagaaaggtgcaatggttgctcttgagaaaagtgacacaacattacatattgctgttgcacgtggtagtgaaccaacagacctttgggatgtaactggcatggaatcgctcgctgtcactccagcaggtggagaataatgcttaacaaatacttcaagcgtaaagagttcgcttgccgttgtgggtgcggtacatccactgttgatgctgaattactacaggtagtcacagatgtgcgtgagcactttggttctcctgtatttatcacttcgggtcatcgctgtgctaagcacaatgccaatgtaggtggcgctaagaactccatgcatcttactggtaaggctgctgacattaaagtgtctggcatattaccttctgaagtgcataagtatcttactagcaaataccaaggcaagtatggtatcggtaagtataactccttcactcacatcgatgtacgggatggttgtgcgcgatggtaagatgtgttgaatggtgtgagcgtatggttgcccaagctgccgaggatggcaactatgatgactggaagaactactctgacttgttagctcaatggaaagggagatgcaatgaaaaagctgtttaagtctaagaaggttgtaggtgcactggttgcacttgttattgctcttgtttctgtaggtcttggtgtagaccttggctctggcacggaatcctctgtgacagatgtggtctgccaagtgattacctgtgaataagtttctagaagtgctggcaggtcttattggcctgcttgtctctgctaagaagaaacaagaagagaaggaggcacaaagtgaagcgaatcatgttagtgacaacccttctgattggttcgctgaccacttccgggtgtcagcaggcgttaccagagaaagcaatggtgaaacctctgaggccgacgctgacggcagtttacgaggtagacgataaggtctgctttagtaagcctgacgctacaaaacttggtttgtacattctctcgctagaacgcggatacaattaatacatagctttatgtatcagtgtcttacgatttactggacactatagaagaggtaagatagcgccgttcttttgagcggactattactagccaatcttcatagggagggttggaaagtaataggagatagcatggctaaattaaccaaacctaatactgaaggaatcttgcataaaggacaatctttgtatgagtaccttgatgcgagagttttaacatcaaagccgtttggtgctgcaggtgacgccactactgatgatacggaggttatagctgcttcattaaactctcagaaagctgtcacagtctcagatggtgtattctctagctctggtattaatagtaattactgtaacttagacggcaggggtagtggcgtgctaagtcaccgttcaagtacaggcaactacttagtatttaacaatctacgtgcaggtcgcttaagtaatattacggtagaaagtaataaggcgactgatacaactcagggacagcaggtatcccttgctggtggaagtgatgttactgtaagtgacgttaacttctcaaacgttaaaggtactggtttcagtttaatcgcataccctaatgatgcgccaccggatggacttatgattaaaggcattcgaggtagctattccggctatgctactaataaggcagccggatgcgtacttgctgactcctcagttaactccctcatagataacgtcattgctaagaactaccctcagttcggagcagtagagttgaaaggtacagccagttacaacatagtcagtaatgttataggggcagattgccagcatgtaacttacaacggcactgaagggccaatagctccctctaataaccttatcaatggggtagtggctaataatcctaagtatgcagcggttgttgcaggcaaaggaagtacgaacttaatctcagacgtgctcgtagattactcaacttctgatgctaggcaggctcatggtgttacagtagagggttctgataacgtcataaataatgtgcttatgtcaggatgtgatggtactaactctttaggacaaaggcagactgctacaattgcacgctttataggtacagctaataacaactatgcgtctgtatttcctagctacagtgctacaggtgttattactttcgaatccggatctacccgtaacttcgtagaggtaaagcaccctggcaggagaaacgaccttctcagttctgctagtactattgacggtgcagctactattgacggcactaataatagtaacgtagtgcacgcacctgccttagggcagtacataggtagtatgtcaggtaggttcgaatggcggattaagtccatgtcactcccttcaggagttcttacttctgctgataagtacagaatgcttggggatggtgctgtgtcattagctgtaggtgggggcacttcttctcaagttcgcctatttacttctgatggcacttctcggacagtggccctcaccaacggtgacgtgcgtctttctaccagtagcacaggctatttgcagttaggtgctgatgcaatgaccccagatagtactggtacatacgcattaggttccgccagtcgagcatggtctggcggttttactcaagcagcattcactgttacctcagatgctcggtgtaaaacagaacctcttactatctcagatgccttactggatgcttggtctgaagttgactttgtgcagtttcagtatttggatcgtgttgaggagaaaggtgcagactcagctagatggcacttcggtatcatcgctcagcgagctaaggaggctttcgaacgtcacggtatagatgcacatcgctatggcttcttgtgcttcgacagttgggatgatgtatacgaggaagatgccaatggctctcgtaaactgattacaccagcaggttcccgctacggtattcgttacgaggaagtactgatattagaggctgcgttgattgcggcggactattaagcgtatgcaggaagcactagcttccctgcctaagtaagcaacaggcagtgcgtaagcactgcttttagcgcaacttttcttaaaggttatcacgatggtagcctttcagaaaaggaggttacatgattcaaagactaggttcttcattagttaaattcaagagtaaaatagcaggtgcaatctggcgtaacttggatgacaagctcaccgaggttgtatcgcttaaagattttggagccaaaggtgatggtaagacaaacgaccaagatgcagtaaatgcagcgatggcttcaggtaagagaattgacggtgctggtgctacttacaaagtatcatctttacctgatatggagcgattctataacacccgcttcgtatgggaacgtttagcaggtcaacctctttactatgtgagtaaaggttttatcaatggtgaactatataaaatcacggataacccttattacaatgcttggcctcaagacaaagcgtttgtatatgagaacgtgatatatgcaccttacatgggtagtgaccgtcatggtgttagtcgtctgcatgtatcatgggttaagtctggtgacgatggtcaaacatggtctactccagagtggttaactgatctgcatccagattaccctacagtgaactatcattgtatgagtatgggtgtatgtcgcaaccgtctgtttgccatgattgaaacacgtactttagccaagaacgaactaaccaattgtgcattgtgggatcgccctatgtctcgtagtctgcatcttactggtggtatcactaaggctgcaaatcagcaatatgcaacaatacatgtaccagatcacggactactcgtgggcgattttgttaacttctctaattctgcggtaacaggtgtatcaggtgatatgactgttgcaacagtaatagataaggataacttcacggttcttacacctaaccagcagacttcagatttgaataacgatggaaagagttggcacatgggtacttctttccataagtctccatggcgtaagacagatcttggtctaatccctagtgtcacagaggtgcatagctttgctactattgataacaatggctttgttatgggctatcatcaaggtgatgtagctacacgagaagttggtcttttctacttccctgatgctttcaatagcccatctaattatgttcgtcgtcagataccagctgagtatgaaccagatgcggcagagccatgcatcaagtactatgacggtgtattataccttatcactcgtggtactcgtggggacagacttggaagctctttgcatcgtagtagagatataggtcaaacttgggagtcactaagatttccacataatgttcatcatactactttaccatttgctaaggtaggagatgaccttattatgtttggttcagaacgtgcagaaaatgaatgggaagcaggtgcaccagatgatcgttacaaggcatcttatcctcgtaccttctatgcacgcttgaatgtaaacaagtggaatgcagatgacattgaatgggttaacatcacagaccaaatctatcagggtgacattgtgaactctagtgtaggtgtaggttcggtagtagttaaagacagctacatttactatatctttggtggcgaaaaccatttcaacccaatgacttatggtgacaacaaagataaagacccatttaaaggtcatggacaccctactgatatatactgctataagatgcagattgcaaatgacaatcgtgtatctcgtaagtttacatatggtgcaactcctggtcaggctatacctactttcatgggtactgatggaatacgaaatatccctgcacctttgtatttctcagataacattgttacagaggatactaaagttggacacttaacacttaaagcaagcacaagttccaatatacgatctgaagtgcagatggaaggtgaatatggctttattggcaagtctgttccaaaggacaacccaactggtcaacgtttgattatttgtggtggagaagcgacttcgtcctcttcaggtgcacagataactttgcacggctctaattcaagtaatgctaatcgtatcacttataacggaaatgagcacctattccaaggtgcaccaatcatgcctgctgtagataaccagtttgctgctggtggacctagtaaccgattcactaccatctacctaggtagtgaccctgttacaacttcagatgctgaccacaagtacagtatctctagtattaataccaaggtgttaaaggcttggagcagggttggttttaaacagtatggtttgaatagtgaagcagagaggaaccttgatagcatacacttcggtgtcttggctcagggtattgtagctgcttttgaagctgaaggtttggatgccattaagtatggaattgtgtccttcgaagaaggtaggtacggtgtgaggtatagtgaagttctaatactagaggctgcttatactcgttatcgtttagacaagttagaggagatgtatgccactaataaaatcagttaagcaagctgctgtactccagaacacagaagagcttattcaatcaggacgtgaccctaagcaggcttatgccattgctaaggatgtacaacgtcgtgccatgaagaaaccttctgcatcttctgcgtaagcaggttaatatcttagtgtacacaagggcaggcttaggtctgctcttagtgtatccaaaggaggtaacatgatttggattcatacgtatggtgtaggtccattccagaagaatgtactcaggaagattcatgagtccgaggagtcggccttagccagccagaaggtacttggtgggactatccagtgctacatgaagaagccacaaggtttcgacttagtgtaaccataggtggtcacaaagtaaccaaagtcaaaattttgatataggcgtgtgtcagctctctcgccctcgccgggttgccccccccccccatagggtggcctgagggaatccgtcttcgacgggcagggctgatgtactccttggatagtacaagggaggccgagggggcgcctaggacggcctagggaatggcttagtggtggacaaggtgattaccttagtgaagcctcttagtgcattcctgaggccattcagggcgtttattagggattgacagggtgggagagcgtgggcta

SEQ ID NO: 25 - DNA, 150995 bp, Unknown
  Myo, Distinct clade
gggcgcaccaagcgccctttctttttacatgtagaggataaacaaaaatgactttaaacgagcttaaaacagcctataacgcaacattaaaaatagccgtgcgttaccgtgacgaatacggttttattgcgcagggtgtgatcctgggcttttctgacgatggtttgatctatgttgatgcacatcacaacaaggttaaacctgaaaacgtcattagcataaaatatctttaaaaacgcttgacaccataaccaggtaggataagatgtatcacatagggcgggaatagttcccgaccacataaaagagaaaaacattatgaccactatcacaacaaaacaagaaaaaattattacagacattgccgcagtagccgctattgctattatcggtacctactatgacaccgcgcgtccttcctccttgcatgagatcgccgccgttgcatcagttggcgtgctgttttacgttggtaaacgttatttatcaccaatgattaacaagctgacaccgtggaaaaataaaggttgatcctgttttacattgtgttatagttatcgtgtagggcggcaatggtgccgcgcccctttgaggatgcaatcatgagtaaagctaacaccgtgctaatgttttccctgattaatgatcccgcttacttgtccaacatgacgcaggagggtaacacattaacggcaacattcaccaataagcttgaccgagtgatcatcatctcactgaaaacagttagtaaaggcttttactcgttagcttatcattggatcactgataccgacgagacaagccaggactatagcgcccctttccctgaatcaatggcacgggagatcatcgccgccgttgtaaatgatggtttgtttactgcataaataatttagaaaaaggcttgcaatcattttgagatagtgtatatttaattcatagggcggcgggaatagttcccaaagcaaacgagaggattacacgatgagcaagtacacagtagaatacacggtagagaatccggtagtatccgaaggtaaaaagatgacatttgccatcagtataatcgctttcgttgtcactatcttatcaatcatcttataaggtgcacaccatgaaaataacagacattatcaaagagatcgcccttgccgctggcgttgaagtcgaggaagtgatcgcgctcaatcttacagaaaacgatctgcgcaactatgaagcggaaagcgtgaaagcaagcggcgcggtcctggtatatgatccggctaacaagtaaggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcgtagtctgataatatgtatcttgtagcgcggcaatggtgccgctcacaagaagagagaaaaatcatgaaaattacaaaaagcctaactaattatgcagcacgtcgcggattatgcttaaccgttgaaaacttagggaaagaagactttttgtgtttttgggagcttgagaatgattgcgagtggatgttttcttattctatctgcgaagatcaaaacggttgtttgttaacctggcgcggtaatatctatttaccggaagaaattaaagaagagttaccaggtacgatcatgacagagagacagcttaaagaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaacatcactgtaaccgatgaaaacggcattgaatactataacggcgacgatgaagaataattaatgaggcgggggagtattccccgccgtcaatagggcggggcaataaggcaacgcccactaatgagggtaaaatcatgttagagaaaattttcacggttgtagtagtgggcctggtgttatcggttggagtggttgcaactatggctaacatgatcctatcttcccacggtattggataaggtgaatcaaatgatcacgaataagacaggtaaaacagaatttttacgcggcttgcagatcggcaagcctgagatctggcattgcactaaatccgcgcataatgaaatgaaagattttaccgctactttacaacgtgttaaaatatctataacacagaaaaaagccttgttagtagtagaaaacgagatcccgcaaactattattattgtcgagcgtacagcatgaaaacagaaatcattattgaaatcatcaacggttataaagaagcctttatttttgctgaatcagccagggatcatgaaggtaattttattgataacttagacgattatgatttttctcctagcgcggacgaacggatcgcccaggatgtaacagcctttattaatgctaatcttgccgctatttctgaggcaatgagcgacggcgcaacagccaaccagatcgggaatgatttacattttacccgtaacagtcacggcgtaggcttttgggatcgccctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaaactggttgttggtgatgtattcgcgttaatggtgcctaacagcagcaaactgggcgcttatgaagtgatggatcataaaaatgaatcatttggcgacggttgcacaatggcggtaaaatccttaaaggatggaatcatccgtcaagctaattggcacaaagggaatcaagtcggattaatatcagctaatttcttgccagaagagcaaacgttagaccaactatcaggcggtaagacgttagccgaactactggaaacagcgatctaatcaacaaaggggcggcaacgccccacatcagaaaggaaaagattatgagtattgcaacagtattaaccgccgttaaaaccgctgaatcatccggcttgcatgttgagcttatagatcaaccaggtggcgatctccttgtccaggtttacccgccgaaagtaggagatgattattattggtgctattctgatacgttcgaacaagtagacacgaaagcgatcacggcttttattttaaaagctgttgaagaaaataactttcattataacatcaatcaataaactttaagcaggggcggtaacgccctattaaacgcaataggaagaggatagaaagcatgaaaaagatgatcgcagtagttgccctggttgttggtattaacgcgcctgcaatggctaatgatttgcctgaatccatcacgttaaccgatatcaacgcggtaaaccggatcggtgttaattatcgcctatgccttgccgctaaaactttccaggacggcacgacagaataccacggattcgagggtatccgctgcggtgagcttgcacgcgaccttaaggaagatccagaccttgaggccataccgatgaccgtaaacggtaaagcttacgtaaaccgccaacaatgagaaaggtaatcatgacaatggggatcatagtagcaacgctggcgctgatccccttcctggttgaatatgtgctgattagtgttgtcctggtagtcagtgacttattggaaacggttggcacctggttttaaggaataataaaatgaatacagaacaagttagaaaggtattagcagcgttgcggtatcacaaccatagcaaggtaaagaatgatcctgattatgtggattcaagcctggaagaagacacattgcaagctataagccacatgcaagaattgcttaaacgtatgacagagaagaacagatccgactttataggtgaggaagtataaaacagcttgcacgatgtgccggatagtgtaagatgtatttcgtagggcggcaatggtgccgctcacaactggaaggaaaacaccatgactacagctaaccgcctgatcgccgtcctgaataaagcaaaggctaaccgcctggatgttcaaatcaaagagcaagcaaatggcgagatccttgctacggtgtccgatggcggttatgtatcagaatcatttttatcagggagcttagatcatcttgtttggaaattagaaattatcgtggaggatatgcagatcatctaatctttacaaaaacagggcttgcttttgtcctgttttttgttatgcttattgaacgggcggcacctggcgacaggggaagataatcaccggaagaccccgctatatattgatagctaacacctatcaaacaacaaaacatcaaagagataaactatcaaatctttacaattccacctattgacaccggatcacgcttacattattatttatcacgtagggcgagcaatacagcaagcccacaaagaggaaaagaagatgagcaaatcagcaattaaagcagttgaaaaagcgcaagaagtgatcgcaacgtcaaccactggcgcaaaggttaatctcgttggttatctgacagatgaaactatccgtaaaaattggcgtaatgctgatttactggcttgcttattgattaatagtgtcgctaatgctttccagtgtgaaacagccgagagcatggaggaaaacttgtttgataatatggatcaagccattgaaacctatatacaatcaaacctggatagctggaacagtaaaacatggcccgacaatttacgcgatacaactgatcaactgatccgccttgccctgatggttgaacgcgataacgttcacaaccgcacaaagtaagattatacaaggggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccggtaaacgatgttaaaagccgtttacaatgccgcatggatgttaccgcatatcagcttgatccggtccgtgtagttgccctggtattagaggaagagatcaaagcaatgcatcatagtaataagtttattggtgacgcgcaggataatatgaacgtttgccgccataaagttaatgaagccttgaaagaatgcggttttaaggatctgatgattaaacgtgatgaaaaattccgctttcgtaatgacctggcaaaccggatctactcaatctatgaagcgttataattgacaacaaaacaaggggcgcaccaagcgccctttctttttgcctgaataatgttgatagattccgcctatggaaaacagacacagaacaaaactgaataaatagcggtatcgagctaatcaaccattaaacgaataaccatacctcccagggtaacaggctgttagagagccatttagagcggttaaaatcgatcaacaaccaacaacaaaccatcaaaaacacccttttacctcctttctagtgcaatgataaccattatcatctatccatgtttatctatgcaatataagtgcataactataatgttgataatagttcgcaacaactaactaaccaacaacctaaaacaataagcaaactaatcataatcaaaggaataatagcaagatgattgataacgacaaacaatcaaaccatgatgaatactaagcaagataacgataacacgacaaaacaaccaactaacgaacaataacaaacgaaaccattaaaataacaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacattagcgcaataacaataatcattgtggtaattacaagatgaaatcattagcatggcaataattatgggggcaatgggaggatgattatcatcattccgatacattgcacactatgcacataatagaataaaaggcaatacttttgggggcgaaatgttaccgccacaggcgggaatgttgagcactaagagaagagcaaatatcatgggggcgaatactatcgctacgcgatatgttgagcatcttctcttaaacgtaaataaaatcagaataatcttgatttattttagtttttatgttaataaacgtttaaataataatcattctcatataaataatagtctgcttgtcatgagcgggatcagttgacaatgttccgtcatatgatgaagttgccaaaccattgataaataagtgtttgtgtgatttataatcaagtggcccaccttgtcgctatgttggcataagccttgcataagtcattgaatacgaatgataattattctcattcgcatgatatttgggaattgtcgctgcgtggacctgacggcccgaaaattcgcgttaagcacttcttacgtatgcgccatgatttttgccatatcatattgattctattagatattcttgccatgattgccatgaaacagggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattatcatgcaagagagtaaaaatgttccgttgagtagtttacgtctaatgaagttttacaaagcttggcttgctggtgaggtagaaggtcacacaacgagtggtttgtgcatatgtttgattaagtatgtagagggaacatatcctgatgaactgttacctcgtctacaacaggagatgaaatcacagtttattggtgcaggactggattacaatttcccgtttaatgaaggtggttatgaggaatacaccttcgaacataaaaaacatatttgccataaaaacaaacatcgtatacaatgggtgctagatagaattcaagattacgaaggagagaaaaatgacaaatagtattccgttgagcagtgcaacattgcttcgcttctataaagcatggattgccaactatcctgcaatgaatcgcacaacgagtggcttatgtggttgtctggtagattatgtaaacgattttgttggtgagacaactagagaagaagatagaagatggcgggatagtttgttggaccgtttgaaatatgaaatgaggaaacaatttacatgtgcagggttggactacaatcttccgttcaatgcagattgcatggattacctttcagagtgtataaacttggcgtgtcataccaacacgttacgtcttcaatgggtgaaagacagaattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactgtaagccgtccgttgtgacaggcagtgaaacgtgtgttatcgatttcattaacgaatacttccgagggaatccggttagtcgttacttcattaagggtctgaaggatgcataacatgaaacgcatgaaaattcgtattgagaatgatggtggttataaaggattggcacatgcaaaatttccacttgtgttggaagccatggtggaatacagtgggcttgctcatgtgcgattctcgaagatgatggaagtgcaggaatggttttgggacgagatagatgcacgagaaggggaagattatgttttctttcctcacgaatataacattgtttattaaaggttgtgtgcaatgatcacaccacaacagaatgaagcagcaatggatcttcttgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgcgtttccattttcaataaaatgttagcattatggggaggtagaaaatgagacaattcactatactggcagcttatgtgcaatgtgttcacgattatgttagtgctcatacaggtttgctggaagttaatagtaaaattgaaggcaatatgggtactgtctatgtgcaacatactttatccaatgtgccgtttaaagtgttcactgttgtagctgccgattacaatcgtgtagatgtgcgtttcttggatcataattttcgtaacgcactagataatatcgaagattatcttcccgtgaaacctttgtcatttccaccgagtcgtgcaaataatgtagtgacaaaccttaatgaaaggaatgtaggctatgcacaaaaaagtccgtcaactgaaaacgctgatggaaatgcaagaagagattgaaaaagaactaaaagaagattttggtatgcttccaaaagacgctttgaaatggtatgatgaactaggaggagaaagttatgaataaaggaactactgtatatttagtaacaaagaataccccaggctggagccaatgcagcactgtcccttacaagatctgtgcaacattagaactagcacaacgtgcagaagcagaagtggatgccatgcaatacagctatggtgagatcattccttttactcttgaacaagaaggagcatacaatgtttaaagaaggtcatgtctaccgtttccaggatgaggattatatgcgactatattctacctttgataacagtattgctgctatcattggagagaattttttcgaggtgttgagcactgatgcaaatggtaatatcttgtcaattgttgtgatagggagagacggtattatcactgctagtgatggggatcgttacataatcaattctgctcatatagattattttgttgacggtggtattcgcggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtttggttgttgctaccatcggcgtatcttttgtttaaaaggggaatgttatgtttaaagttaatgctgtttactgtttcaaaactaaagctgcccgtgaagctttctctatgatctctgatgaaaatttcaaaatggcagctttgattgaagggtcttgtttccgcgtcgaagatattagtgaatcaggctctgtttgctcattgactttattggacagcggggatattattgaagctggacagtatccgttcagaagttgggggatattgttagctcgcggagagcgtaacttttttatgtgcgtgtctgcggaggaagttgtgaaagaaactaaggatgtttctgtttacaattctgaatttataagttatagtgagtatcaacatctggaaggcattgttggtcacttgttatctctgattaacgttgaatgtgacctgcctgaatcattgaaagaagagttgaaagcattagatctgttataatgtttcgcacaacgaaaggagaataagatgaatctgaccgaacagttacgccgtattgcaaaagaagcttccttcaacttccctgttgaagaagtgattgagacatgttttgctgaagcacgagcgggaaactcttcaagaaatttcacgccatctgattttggtctggataattcccctacccacccaggggagatctacaatcaggtgaagtggatggatgaagcagtagcaattcttcgtgagcgtgggcttattgtttataaagaaatggatctgaacggggcatacgagtggatcactgttgattggtccgaggtgaaatgatgaaaggtaacaagatgaaagttaatcaagtgccgagcgcatacactttatggcttgcgcgagcgttacaccagacgatcaaagaccctaagaagccaatgaagagtgggaagaagtttatgtctaagggcaaaacaacctttggcttcactcgtatgtctgtcaagatgaaaaggctggggtacaagccaaactacgctcgttacccttctgaatacaactggtttgactaaaaggagaaagactatggctacttttcaacaactgaaagatgtttcacgtttagtaagaaaaatccgagaagcagacgctgctgtgcggaatgcattaacgccagcagagcgtgaagatcttgaagaggaggtgaaaacagccgagaatgcttttgctgcgtatctttcaacactgtatacaggaggttaaatgtcagaagaacttaaagaattttatcaagcatatcataactggctgttagctggtgctccagataataatcctttctggcatgataaaggattatgtagttgcctctacctttggactggaggttatgatgatctaaattatgaaatgcaaatgcaattccgtgaggcaggattatctgaagaatatccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttagtaattgttatggttgttcttttcgcggcatggctttgggattttgacccaggagcagcgcagcaaagagctacagactggaaagaacaatgtattgtgctcaaacatgaacgaaatgcggagaaatttcttgacctagagtgtgatcgccttgtaagatacaagcaagataaataaccttgaggtgcaaaatggtaattgagattaaacttgaatatgctggggctgttgccctgatcgcacaaacgttgggagcaaagattgaagaagtgtgtatcaatgcctggagtgtagagattgatgttcctatggacaacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagcgatgacatgacaacattctttgttacgatagaagaaatgtccaaagttgagggatgggagtggtttgaagaagatgtttgggaaggttgtgattacgtatttttctctgatgaagtgaatgttctttcggagtaggtatgtcttgttttacaaaagcagtgtccatatgtaagaaacagtatgaaagtgattacggaatatttaatattccagtggatcatacaaagtattgttcatgtggtggcagaatgaagaaaacagtgatttatgcggatagtggagacgaacttgttccggttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttattgttactcattgcatcactcggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggtggtgctttgatgagtggcattctgcaatacacaggagaaaaaagtaaagatggtagtgctatgtatggttcacaacagtttattggcactactgaagttgtgatgatgcgcacagagtatcgagacactttagcttggtttgcatttctaaaaaatgataaaacaataacgaatgttcttactctagaagctgattgtacgcaacgataagggggatttatgactaaaatgagacattacgctgtaaactgcaacgatgcttggcgtttgtgtcctgatgatccgacagaaggtacatttgtaagatatgaggattataaagagttatcggatgctgtaatcgcattgttaactgatatccgttcacgttatccaggacaagatttcacttgccctcacatcaaacttcttgcttgcctggtagaaggtgagaaagaagtggaagatggcttcaagcgtgtagagtatcaaggtgaaactttagatgttcctgaatttgttaattatattgcaacagattcaagtggcgagcgttatggttacactcataaaccggagattccagatttcgcttatgcgtggcgtattccttatgaagtttttaatgttgcagattgctggtatttaggagaaggaaacaaccttaattggcgtgattccttggttcaggtttaacaatatgaaagagacattgccagcagcataccgtttgaatgatgaacgtatttgggagtggaccgacgtttcttgtttttaccctgaaatagttcaatattggcgagcaaaagggtgtgttgtagttatcaacccatgtggaccagtggatgaagattgcttgtatctcgatggaaagtggcacagttattgtcgctggccttttgagtggatgtgtaaagaagatctcccagagggttgggagtatccaaaagcaaataggagataatatgtctgaagattttgttgaagtgtttgtcaaagacgaagaaactggtttaggcacaggtttcatttgtgaagaaacctttaaacgtgaacaagaaaaagctattcttatgcgaaactatgatcacgcattagaacaatggaaaaatgcagaacaaaaatgcaaaaacctttatgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttctatgttaaacagaagtctgtagaaggagagaagtgatggaagaaaaactggaacgtattatcgagttagccatgtctattggctacgacgattgttttctccaaactattggagaaacagagaacgattacgactcttgggtgaaagagttggaagaacttaaaacttccttgattgctgactttgctgaagcagaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagggattctcgttccctctgtttaaagttcagaagcttagaacgcgcaaacaaagagcaagaaaaactaacgaggtggctaaatgaaaacaagcgcaaggttgatggagttttataaaatttatttagcatggattgatgttggtgctcctgatggtaaaccttttcggcgggattgcggtttgtgtgccaacttattcgactatgtgcacgcggatggctacaatccccttataacaaccttgtcagatgaaatgcacgcacagttttaccacaaagggttgagtcaagaattacccttcaatgagaactacgatgcatatgtcttagaatcagatgcagaggtatgtcacctgaatgtggatcgtgtgaactgggtaaaagaacgtgtagcagaagaaataattggttgacagagggatctgtctttgtcataatcatctcatcgaaacagagaggagagaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccatttgctttagaaggagatgcttgggactgggctgaactcaatccttgttgtgaggaagaagaatctatgttcttaggtttaaacgtttaccgtgtagattacaccatgtgcggagcggaacattctgttcgcgtagaagccgaatccaagctacaagcacctttcaaggcgggattgactttgggtcattgtttggcaaacattgaagatgttgtgatccaaagagttgttttagagaaagaggctatttgacagaaaacggtgcaatatttaaaatataaagattaaccacaaaaggagagaaaatgcaagttgaagacctgatccagattctgaatagagccaaagagaagggtgctatcaaagactggaaacgtgaaacgagtgaagacctatctcactgttgccgagaattttacatcgaaggtattgctgacgatcattatactatcgaatggtatatcaacttaatgacccttaagcacggttcatttgagatttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatccttcttgttagctggtttaggaggtgttctcataggtttggctcttatctggtgtattcgtcgattaatcgggtaccgacaaaaaggtgtttcatgttttgtatcttacaattttacaactgcttacagcaatgaagttggatctggcaatgctcaagcatttttaccaacatatcctcctacggtggaagatattcgaaacttggaagtagaacttatgggactaagtgataactatacatctctagttattcaaaatatttttcgactaaaacaggaggcgtgaatgaaggtacattaccctcatccctttgatcctaaaaacaaagccgtaattcttcgtcagtggcaacgggtttgtcgtactaaatgtccaatcaatagcccacacaatgtagacaaggactatcttggtacatttgttgaatacacttacatagacaaaaacaagcgtaaacaacatgtcgaggaatactgcttaagagtagaatggctgtaaataataaataccttgacaagtgtttattcgttttgtaaagtgggaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctctgtagcaactcttctagagatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaagggaaaatggaatacaactctgttaaagcagacgcttttgcagagacattccgtgaacgcttggagatccttagagatttaaatacaccttacaaaactattgctgaaaaattcaatagtaagaaaatagcaacagcacgtggtggtaaatgggatgctaaaactgtttctcgtttgtgtgccagactgaacattaaataggagaggatatgaaacaagaaaatgaatctgtagatcacttaatcatgctgtcagccctttttgccggatgggacgtattttttgaaaatttgttcaattcttctacagatggttccgattttatgcgccagtttaaacgacgaactgttgaggactatgctttctattcaggtcggattgaaaaaggttacgaagatacaaatacaacactcaccattaaagttttagatgtgatgtttagtgttatagatgctatcgacgaaagtcttccgatcctagacaattgtaatacgaaagcctatgtttacaaaatagctcgtgcttatgtgtctgcaaacagttgtcttctttccacccagattgccgtgaacaatcttgccaacttgtttgatgaaggagaaactttttatgacaatcgatttgaagtgtaagaggattcttttagatttctataataattggttagaacacctccgtctctttccaagagaaagtggttacgctgatgttggcttatgccgaggtctgcgtatgtatataagtgatgaatttcgggcagagcattctttagcatattctgtttatggtatgcaattagccagttttgaaaacgctggcttagatacaactttcccatttaacacagcaaaatcttttgatcaagagtgtaaggaaaaactttgcatgtttaatgaaaaacgtgtacagtgggttaaggatcgagttaaacaactggaacaagagttggatttcttctatgatgaggcagaataatggatagacaaaccttaaaaacaatggcagatgccactaattccccgtactttgaaaaagtaagtaaattggtagctcaagccgcagaggaaggatattataacataaacatccataacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttgggacaatttactgtaggggaaacataccctgtcattaaacataatcctaacatcgcaaactttgataggatggttcttgttgaggacgatctgggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctattcctaaagaaggcaccgaagttgaagttattgcacatcgcacaacttcgcatggtaacgatgtagcagttgttttctgggatgatgaaggcgctgcttgtgcaggtggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatattgtataacttttttaaaggttggttgaaatgggcggaacaagctcctgtcggagattgtgtttttccttgggattctcgtcaaggcttgtgtcgttgtttggaagattggcttataaccacaaactacaattcagaaactaagaaatctacatcaaacagattaaaaatgttgtttgaagaagatggtttagatccaatttatcctttcggtgaggaaagtttccacaatggtcttttccttggcactcaacattatgataaagatcgtgtagattgggtaaaagaaaaggtagcacagtatgaatggggttaagaattatcaccgctggttagaaagctatcttaagaaatgtgaacttggtgttccaggttatacttacgacacggacgagatccttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaatgtttcggttgggacttttattactaaacgtcaagcagaacaagtaagagatactttaaacaagtaaatttttaagggggacttatgttaggtaagatcaaagcttttttcaaacgtattgttgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacaggcttgcagctatagcattgcttcgtggggagtatgactattgtttatcagcgccttgtaaaaagcatctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttgttgttggatgttggttgggttcttctgttgtgatgggagaatggttaacatacaatgtatttgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataaatcttacctatcaatctaactcttaactagtattgcacctatagtaagactattcctatagttattaaccctcttcttctgtagaatgtaattagatccttgacaaactcacaaagcttgtgttacattgtgtctcacaagtgaataatactgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcgcaaattttagagcaaataacccctccatacctatattcaaatgttgagcgttttaacgatgcacttggtctgacattaatagcggagtggtaataatggcgaaaatgttagcaattgatgatgttgtaacaattactacgtccataccttgtcctcctatgccttgcccctattgtggtggttcagggtatgttatggcggatgtaggtcaaatctacgagtgtaatccgtgcaaaaccacgggttatatccaaatagaatcagaggagaaacactatgagccaaaacgctaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggcgagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaagatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgctggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatgcagtcatctggaagttgttttggtatacctcgttggttttttgattctatcaaaaattctactacagagggatcagactatgatcaagatgacatgctttggttcttaaaaaaccgagagattgttctctcaccacttaaataaggagaaataatggtttcatttatcgtaggtgtagttgtaggctatctgattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaaaatgggacaaaagattgccccacaatcgtaacaaaagctgaatatgagaagtttttctacgctaaggcttgacacaggaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcatcgagttatacgagagagcactgcacaagtaagctagaacccacctaaatcgaacagagacgctctaaaatagaaaaggcacccacttgggtgcctttgttttattcttcgttagattgcgtctcagacgcgttaaattcggtttcagtacaacttgctaggtaacttatattttgcatcactacaactacaggtgtttgaagtttatcttctagccccgcagccacttgagccaaggcattatcaatatttgatttcctaacgcctgttccatgtcctgttgccaagtaaagattaccttcccctttttgtgtagcattagcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatattaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacacccgcttgttccagaagatcatctacgtttgtcgtgatgttgataacacgatcacagccgtactcttgaaaccattccgcgatctggtaatgcgcagcgttaggagacacactatccatctctacgcgacgtttattgtagaagtcatgagttttacggtagaggttgtatccctctgcatctaatccaccaacagcgccaggaacacactgttcttgctggtagccagcacggaaattgaaaatgtcacacacttcagaaaggtcgtattcatcccacaaagctttaccactttctgtgtcagtgcggaaagtacgaataccgctatcggcgcttaagccagcgccgctaatcactattaatcgtcttggcattcttcctcctcaaatggatcataagaatcgtactcgtaagtatcatcttctgaaaattctacttcgaaataaatatcaaactctgcaaacagacgtaggatgttagacatgctgtaataattatcgtaggcagattcagcttcatagtaaacataaagcaaatggttagccttatcatcttccaaatatttcccgtctgcatacgcatagtctgcatatgctttacctgcatcttccacaagagaacgatcaagcagagtaggaaatggtttctctttttcttttagtttgctcaccaaccaatgtgcaatatcattccattctgcatccataccactaaagcaacttgcttcttctccaaaagaagcttctcctaaatcgccactaatacgaacaacattagatgaactatagccacacgtttcacaatcagagtaactattatgcacattgacatttacttgaaacatattccctcctataaaagaaaagccccctgaaacaggaggctttgttcagatatcggcactataccagactttgaaggtatttgtcaagtgcttcttgatcaccttgacaaacatagcaacggaagtcttgagcagaaggttctttgtcctcgtcccaatcccaatagacagtacctttatagcgtgagcctgggaactcgaagtatgccacatgagtaatatggtgtgggccaccccaaaactctgtaaaagtaaattgaggatacgctgctttaactgtattttcaaaccaagttttacgatctaatgcttcgtttataaaataagcatggcgttccatttcatcccacgttttccagacacttctctcatcaggagaaaagacaagccattctggaaggtagagagtgtcatagtaatcatcatattcgatctcggagacgcacgaagctgactcctccagttttgagtaatcaaaagcagaatatacccaccaaccatcttccagtaacgctttgatagggacgaagcctttatcagcatattgatcgaattgtttgacacggtggcttgtgcagtcttcaaactcacattctaaacgatatgcaccttttcgacgagcctcaagaccgtgtgcactgaaaataacaacacttccttcaccatcattacgatctacttgataagcaactacttgttttgaatttgacattatttctccttatctagaagattgttagacaaaaacactgcacgagcaaaaccacgtgcggttaaggatctaagttgttttgtttttgcactagctccacctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatactcataaggatcaaagtaaaaatcgggtttacgccataaggttgaaagtttacctactgggttctcaatcatccaaggaacattatatttgttacccaaagcttccactacacgaatattagctaaagcttcatctagttcctctgtgctacgttcgtgtttgctaccactacctgctaacatagtgcaaggtggaaatccaaaaataatatcgggtttaggtatcccatgatcttcagggttgaatgtagaatctatccaggcattcacataggttatgtttgggtgctccatcctaacctcgtatttaccgtgatccccttcatcagcgtttacacaaaaacacttgtgacctgcttcggcataacgtaacaccataatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgctgagacattgttttatgccgtaaacctaaccaacaaggaacagatactttagtagtctttaatctgtgatcaacagtattagagtattcaataatagctgtcagtttcaatcgtgctttttctaaatcctcatgggtcactttgaaataactttctgaaagatatccacacatattaataacctccttcaaaaggcttaactacatgttgattagctttaaaacgttcaacatagtcgttttcgcccatgttttcatatagcttagtaacaacataaaagttttcccaagcatattccctaaaccaaccactagtgatggatgtgcagactttagataaagccattataaaactttgcttaggggttggacctccgatctcttcaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgctggagcatccattaacgcgattgcttcatggatagaatcatgatcataaacatacggaacctcgtcacctttaaagaagtctttactttttacgtttaagttcggatgagagtaagtgtatgtttctttctcacgtaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcatattccaaatgtgcaccagctatcattttgacgtggcctttgttccctttacgttctacaagttcaacaaactcgtcttgagagaacatttttgataattcttcccactcttgttctgtacacaggtaatctaaatctacacaagggcgatacaagtcttttcccatgtccatagcatgaatttgtaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacagagttcttcaatttccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcatcttctaagctaagaccaaaaccagcatcttcggcttcttttgtaagttcgtccactaaagccataatagcttgggctttttcagttaattcttcaatgttacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagcccacaattcagacattagagcatcaaagattaatcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggagagaaactgaaaccttcaccagtctcgtctgctaactgttctgcttccgctaaagcctcataagctgcttttacggcttcttctactgttttaaacttggtcgtcataaaatttctcctctcctaaagacatgttgacatgaaatgcgcggtatgtaaattcgttgtccgttgtgttagaataaaactcaaattgaacaacaccgtcttgagaagacaaatacatgccaatttgaactgttccttctggtaccaggtaagcatactctggacgtagtgttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacatctctccgaagaaaggcataagctttattaggtattgtagactcatatttaaccatatctggcacagcaaaagatactactactcctgctgggcttctgtcaagagccttattaatatttctaaggatatcgttagccaagatttctgccaattctccaagaacagtttcggttatatctttatatcccattaaatatttgttgatatctttcatctctgtattgttcagagtatagtctaaaggataaaaattcaaagaggagtcacttttatgtgtccacatgaaatgcacccgatccgagcagaatcgtaaccctctacgaagaatatcttctacaacagggagaatttcttttgtcacatcattaaccatgttgtaatctaagatttctgccaagtttgttctttgttcaccacgtttacgtctaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacatgatggagcaggattctccaaatctctgcctaacacttgatgcacattacgttggtgcaattttctagcaccctgcttaagcttttcataagctgggtgaacatctttgatccattgcacagagatagcatagttcattgtatctggttttgcaagaacaataacatcacctggaatctgattacctttgaaattttcccaaggaacataaatttccttgttagtaggattttcagactcttggacacctgtttcaaaagcagaatcactaccctctgccttaccagaccgtaatttaaacccaaggtttgaaagccatttccctatgcctaccatcaaagcccactcttcttcagatatgtccctacttccaactcctgtatagaacagttctgccataatcacctcaacaagtaatttcaaaaggtgtatagggttccgtatttctcataatccaaggactgctaggattgctcggatcataaggaccaaaaggttttatggtaggttgtgtttctttcttctgaatctcttcaaaaatacgacgaagttcagaatattcttgatccaccataagattcggtgcatctgattctacagtttgcaggttatcttccttaagaacaatctcacgaacaagattaacatcttctgtttctaagataacttctttacggatattacctacactttgaataattgtaattttatacattaatcctcctcaagagttgaataaaattgaagaccaccatccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaagatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaataccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacgatcagtaagatctcctaaagatacaaccacatctgtatctcggatacctaactttgcctttcctttttcatacagattataacaaccatgtagatctccaattataaaaagatcttgatcgcttttaacagtaatttctctatgtatgatcacttatcctcctcaaaatctaagaaaataaaaatattcacctttccttcaatctcttgttctaaaacaagatcggcaaattctgcataagctttctcttcaactttttcaatatgctctgcggcatctttaaaaggcgtatccccatccacctttactaataagaaaagagatcgcatttctacgcttttactgttacgaggaaggaaatctacagcttcaacaattctccaacccaaatagccaggggttttatgaatctctcctaaatacttttctaagattttacgaccctcgtcgataagggcttgttctgtagtaatttccattccttcctcctcaaattattaacgaaaccgcatgactaaatcttggttcagatataacctctgctacagtaacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccattaggtatcaatttcgcctcaacctggttaagtatgctttgagatggttttgttacataaaaaagattttctgttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggattctagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattagtcttcccagtcattgccctcggtagagtgaaccaaagctcgcacgataccgccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaacgattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatatcgggacgattttcccatttatgactaaaataatctttaccttcttcaagttcgcaatattctgaaccttcaggaaaatggcgataaatcgcttcagcttcacctctacaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataatcctatttgatcagcctctagaggataagtgtttttatctgtttttctagacagaatatcttcaacaaacttatcaatagccaaagaagaatcataaaattttaaaagttggtaatccataggagatattttgtcatctcttagaaatatttctaacatgttttcagtagtatcgtggtttagtgtatgttcaccaaaaatattaacttcgtaaacatctttgccaaaccaacgtttcttcttttcaacagtataggtttttgccaccagaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaagaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactgcaatcacgaacaagcagtgctttcttattaaacaaattacttaagaacagtaacttcgcctcttcttctgttatgtgcagaaggctaggatcggagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgtcattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatctccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggctataccatcggcttttacgcatgtttttacctgcttgagtataatatgcattgctgattaaagtcaagctattttgaaacccttcagcaccttttaaccccaactggaaaaccatgttgattattcccaatttacgagtatcactaaccttatcatagattggtgataagatagcactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcggacagaatttgtggaaatgtgcgtggaggaactccggtaagatcaacaactgttttagtcattgattctaaatcatagtcttgatcaagacttaaatattcaaactgtttattgcgcatggttaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcgctatataccgaggctgttcgaataatatatgcatttgggttaactcctcgcaccattttttcaccaagttctttcgtatacccataattgtttattgggttaggtgtagtatcttcaaaaataggatgagaataattaaaaatatagtctgtagaaatatgcacaaaatcaattttaagtttgctgcacactgccgcaatatttgcaggtccatacgcattaacagccaaagcagtagcaaaatcatgttctgctttatctacagccgtataagcggcgcaattaataacaccatctacataatcttcaataatagcgtttcgcacagcttcaaaatttgtaatatctacacgttctttaggataaattaaagatacatttgaaggagccactttacgtaaagcttgtcccagttgtccattaccgcccaataccagatatgttagcatacaccctcgctacgtaactgttgaaaagatttagccattgcatcttttgttgatagaataggtttaaaaccttcgtcaaaaatcatatcgaagccccaatcgatccctatatcaggatcatcccaacgtaaactttgttcactagaagggtcgtatggagttgtgcatttgtattcaaagatagcatccatactcaaaactataaaaccatgagccaaaccaggcggaagccaaaactgcgtatggtgtcgtgcacgaagaacaacaccgtcccaagcaccgtaagttggactatctttacgtaaatctacagcgaaatccaatacttccccacttacacaacgaactagcttaccttgcgggttatttgtttgaaagtgcattcctcgcaaaacaccgaagtttgatttagacatgttatcttgaacgaaagtttgtctaccaataatatcttcgtatttttgttcattatatgtttctagaaagaaaccacgatcatctttataaacgtctggtttgataattaccgcaccttcaatttttgttttttctactttcattttctctccgctaatttgagtaggtattgcccgtactctgttttcttcagtgagtttccatgatacaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttccacttgtaacttcctgtcttctaggtagctgcgattgatatcagtgatctccagttctccacgcgcggaaggggttacttctaatgcacgttgaataacagagttatcatagaaatacaaacctgtgacagcataatctgatttaggattttcaggtttctcttcaatagaaatagcttgacgattactcccaaattcaaccacaccgaatcgttcaggatctttcaccaaatacccgaaaatacaagctccgccccaaacatctaccatctcactggcgttaatcagtagtttaccaaagctttgtccgaagaataggttgtcacctaaaataagagcaacagagtcttctccgataaaatctttacctatgatgaaagcttccgcaagacctcgtggctcggattggattgcgtaagtgagttttatcccaaacatagacccatctccgagaagatactcaaagtcttcctgatcacctggtgtggtgatgattaaaatatccttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaattttctcactccaccattgagggttgtttaagtaccattcaatcgttgagtagagatcttgttcaaatgtagagtttgcactccagcccagttcagactctatcttagaaggattgatttcataacgcaagtcatgtcctttacgatcttcaacaaaagttatcaagttggaagaagggtaggttactgcttctggatgtacagtatccatatagtcacaaaccatatagatgatctccatattggttttgggattacgtgttccaacattatacgtttgacctggttctccacctgttgtcacttgaagaatagctcgcgcatgatcctcaacaaaaagccagtctcgcacctggtcgcctttaccatacaccggaatctctttattcgtcaagatacttgtgatgatttttgggatcagcttttctggatgttgataaggcccaaagttattggagcagttggttatcacaacaggcaaatcgtaggtgcggtgccaagctttcacaagatggtcagatgctgccttagacgcactgtacgggcttgaaggggcataagctgtctcttcggtaaagggaacgccagagtctgccatatcgccgtacacttcgtctgtggagacgtgtacgaacatcttcagtttattttttgggaggagccttgcagcttccaataaattgtatgtaccgataatattggagtcgatgaaaactcgtggattcttgatagaattatccacatgactttctgccgctaagtgaatgatgaagtcaggattgcactctactactaaacttttgacctgggtttcgtttgccaaatctgtcatgcttagtttaacgtgagtgatatcgcctacattctcaatatctgctgcatagcccatcttatcaacgacaaaaacttcgttattaggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccctctccgccttctaaatcaaggccatatatgcaataagactcatccgcatcgtagaaaggagagatgcggcttaagtccagaccttcttgtaagaaccagttaaaatctccatcaaattcttcttcaattctaggatcttctcctacagcctcttcccatttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcggacatattctttttcactctccatcttctacctccaacccttctttttcaaagattactactcgtccctcaccatgacaattcaggcaaggaaatgttaccataatttccacttccatctgtccagtcccaccgcacacaggacaaaaaataagtttttcagccattattcctccttaattatttcaaacttggcaacaccatttacaataatatgaccacaagacataactcctagccaaggatcgccgtttttcttcaggcgtttaccgaatacatcacaaaaaccattcttcatttcggaggcttcataagaagcccctttgtcaaaaacgtctttgaatgtgtcgattataccaacacatctcaaaatcattagaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcagcgttaagacctacaataaaacgaccttcactaaacaggtagtcacaccactgttcctcttgttcaacaacagtgtcgaggatcaaagtcaactcttcaatattgtcttcgtaaattttacgccaaattgggtcatgcatcaatgcatcaattacagcataatccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcagtcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcgttttcatcccaatcttgtgctttttgaagtttgtagagtttgtgcatttcagggtaagtcacgttgatagaatcaaaaatccccaactgttcccccatgaaaactggatatttacctgttttgtaagtctcgttatgtaaattaattgctgccatttaaatcctccactatttcacaaaaacctcttaagcttaaaatatcttcttcctcaaaatcattgctccggtagaaagcttccagtgcttcccatacgcttctaccaagtataacagtcactgtttcttcacttcttgcccttgttattgcgtaagccgtggcttctggataaaaagattcccaaatctgcatgttagctatttcaagaccgccaagataatggtgacaccaagtaggggtaaaatcttcagggcgaatcaacagaggcttaaacccaggtcggtagattggggttactccaggtaaaactataagtgtgctcataatcctcctcaataaaaaggggctgaagcccctagtttcatcacattttgcaagcttcacaaccaccatcagaatcttcttgtgctaaagagtctgctgattttgttctactgttaaggtaatacaatgacttgccacccagtctagcaaaattcagaataaactgcatctcagctttcactgataaacgtccacctaccaatttagaataatctagccaagaatcacaagaaattccttggtccgtaaacttggtaaagataccatacatttctgcaagatctttagccggagtgtcccaggcagactggtagaacattttcagtttttcatagtctggaacaataaataatacactacctttctgactttgtttatacataatagtatcacgaacaggatacagagagttagtagtattgcttaccaaactgctggactcattaggtgcaatagcagccaagacactgttacggataccaccttgttcaatgatttcagcacgtaagccttcccagtccattttaagatcaaaattaccgatactatctactgttttagcataagtgtcaattggtagccaaccttgaggccatttggtcttatcgatccattctgcattacctttttccttagccagacgcagagaggcttttgccaaccaaaagtaatgacgttctgcaagttcatgcattaattttttagcataagcgtctgaataatttacaaaattacttgccaaataatgcgctaagtttgtaatgcctacaccaatagatctacgtgctttagcagttatttcgttatgtttaaatggataatccattgtttcaataacgttgtcaattgtcaatacagtgtagtatgcaacatcctcatattcttcaggtaagacacgaccagcaacaatagaagataagaagcataaagccaattcttgattttctgtattctcaccagtaaagagatccggcatactgtggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaagtctggttcaagtatggtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatggctaaagactctgccgtatcgtctgcacggaacaaacaacaagacgcacttcctttgattggagttcgtagagttgtcagatacggcgatggcagattaatcttaagatcgctaacataagtataaagttttttaatatcttctatacggcgttcttttggttggatctccataaccttcattgcgataccaatgaaaagaaactgtggagactcatgcaccacatcgtttactgcatctcgaataagatatttatctaccatctgacgtaaaacagaataaccataagttagatttttattatgctttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagtcttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttgatagattcgtttaaaaccacaattaggtgaaacagggaaagtgaaaagcgttgtatttgaaaacactactcgcttatcgttattgcttcggatattcacattacactcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccatattgttcgcatgtttcttgaattggagtggcttgatgttcaaacggagaagcatgaaccttgcgcccagtcagcaaacgaccatagatatctaaagctttatctttagttgcatttaaacgacgatagctaacctgtgcacaacacgaagctgaaatagctttggcttcttccaaagtaagcacaacaacttctccagattcatcttgaacatagtatccaccaaaaacaaaatgatcgtcaccttctgtaccaatattatcatagaaatggtctacataaggtgtgtgccattgccctggtttcagcacttctggtgtagatccttcatactctttgtgcatctctttagccaaagcttcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcgaaacgtgctgcactaagcgcggcaagattccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacagtcggtgagtcatcaattctgaatgaataatacgtggatattctagttcaaaagttacaatctcttttccgtcttcagtgatggaatgcgcaataatactagccgaaatctgtcttgtcattttttctccttagtttttaaaattgtttaaagtgttaaaaacatccaaacatgttagccactgatcttctaaacctgtgatcacaacatttggttttttctttagttcttctaaatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaatgttcttaaaacatgtttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcgtagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttacggcgttttgctactgtgctttcaggttctattttacgcttcttcagccacgctttatctttcttagctctacacaaagctatcgcttctttttcagcttttgcttcttcaaaagatatgccttgcttgtctgcataagcaagaatagagttgcacaatttacaaaccattcgcaaatcttcttctttcacatagatcaaacggaaaacaaaaaggggaatatcctcaaaacattgaagttgttttgctgcgtgaatatgatccacttggaagtctttcattcctcctctgtgtccacatatttcgcactcacaattccaaacttgttttggttttccagttttcttgtctatcatcacattgccgtctttatctacacgatcaactttaaaacgccttgcattgataaccttaattttattagggtgtctcatccatgcttttctaaaacatcccctaagataagtataaaattcagcttgtgttttccagggtgttccttcaccccacattatttttggttcacctgccaatattgctcacctttttagctgtatattcccctggtgggatattatgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtattaaaggatcttttgtgaagaaatcaataagaagcatagcttgatcatgtttagctgcatttgtcatagatggataattttcacgaaccatatacgtgctattttgcataagggttctttctagttcaatacaatgaatagctttatctaggttaatctgacgttcacctttaatacgtgttgcgtattttgccaatttgcaaaaacaaggtgtgccaccaaccaaataagctagttcaataggttgcattaccatttttgtgtagtgatcaccgtcaacctgattatcaaaagcattagacataattttcctcctgaattcctactgcaccttcttctgggtagtctgcataataagctaccctaccttgatagataatatcaccatcgtcattataaattgctgtaccttcttggattgttatttcaacgtcaagtaaatctgggtctttctcgatggtatagttcaaacctaacatttcaaacagttcgaaaatttcgttacctgttaatgtaatgctcatatttcctccttttattgtggttagcagagtatacactaatataaaatttttgtcaataaaaaagggagcaataagctccctgattattagattccaatgatagttgctgctcgtttatccttggatctggtgtttgctctactacgtgacaaacctccacaagattcacaacgaatgatatcgaaagaacttaccgcagtgtggtattgtttaccagtaacaacgtgaacgtgatcactgccacaacgagaacaacggaccttctcatctgggtaataagcggataagttaggatgctgtggaatccacggaaggattttcatatacaaatcacggagcgaaacaacatcaccatcattgtaaatctgcatacgttcaaaagcatcacgatcaccttcacaacatgctttccataaagggaacccctcgttatccagtttttcactttctgtttcgaaatatgctcccatttctttaagggagttggaaggaagtgcaaattgtttcttagctgccttcaatgtatcaacaactacataattagaaggaggagccatatcgtgatatgcaaatcgttggttaatgtatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaggtcagcagaagagtaagataacaaataacccctacgaattacttgatctggagaaatgaaggctttgaatcgacggaaagtatatgcaatctctggtgcagtttcaacatcaataattttaataacgggttgtttctttttaactggctcttgtttacttgctccaaatcgtgcaaggaaatcgttcactgtgctttttcttgttggactacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagctgaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatatcgccaatagactcgtcaataagaattatatctggatttttaaatactccatcctctttgtagaaattaaaaaggatactaggagtatgtaaactatctttatctatagatactacgatataagaaaatttacccgtccttttataatctttatagccttggaaaccatacttctctaactcatcatcagcttctattacagtaacaacatcaccattgtggaactccacaagataatctttggtttctgaaagctgaaggggtttgatatctaatcgttcagatttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaatgatttcgaactcttcctttgtgaagggacgtttgtttttggaggctctttctgcatttgtatctcctagccaacctccaattttagtcttgcttttaccccaaaactctgtcttatttttaaattccttttgagcacctgaagggatgtgcttcgcaatgattgttcttttctctaatgcagatgctgcttggaaagcgatctgatcataatcaattgcagctattgtttcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtattgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggaccgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttcgacagctttagactcgtatagggattctttactccaaacaacaacgccctcgctatcctccattttgatataatttccgagagtaatacgatctgcttcgtgattctccagcaattcaccaaaacctttcacaatagcttcttcatgcacactaaaacctaccgaagggaaagtccccagaacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttccttcattgctttgactacttctttatcgacataaaactctttaccttcgctctccatgtcctgacgcatttcttctagacgttcattcaaaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacaaattccagaggaatatctgtaatgctgttaatggatgctacagaagcattgtcaccaacaaccataggcagagcggatttaaaagattttacaaacatgtttcctcctatttaatacatctcacattaccgcccgtaaagggcggcttacaacattacttgttaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctggatattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaagtcagataactggatactacaaaaatatccgctgctgcatccaagagttctacatgatcgtttactttcgcggctgtttcatactctttaagctcttcacgaacgaacccgatttgggacataaataactcttgagtgaattcaggttgttcaccacctcgtgctttggcattccaatcaattacgtgctttgctgcatttttgaaaaattcagtatcgaatttaatatctttaaaaaaattctcgatcattataactccttatttaaaatagctttctagaaagttgctaatatttactacagtctcacccatgtaaatccctgcgaaaccgaaaacaagcatacgtggaatattgaaataccatttatctgccggaaaagatgccagaattacaatagcaattgctatcaacatcataagaattgttgctaaaattatcataaaaatgcctccaggtattttgcacaatgataagctaagaacatttttcctccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattgatagtctcatgagcatctttacgcattaagaattcgactactttaccattttccatctcacctgtcaacactccatcgccatttttatcactttttgaatttattactttaacttcaagcgtatgacgaggcttacgtttaataacatcataagaacgtttatcaaattcgtaaactccgtgagtattacgatatactacaccttcagctttctcaagtaaagctttttcatagaaagcatcaaactgttcttggttttcaatatactctgtatgaaccacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactcccctttcatgttaatcatagaacgtaacccgttcagtttgtattgtgcataaccagggaacacaaccctttcaggataatctttataatcctggcatttcattggtgtagaaggaacatggttttcagcttcttcttttgttttataatagccattctttaactgttttgtccatttggcaaaagcttcaagttcagcttgttcttccggtgttgtttcattggaacgaccaatgtttttcgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccgacacgtccacaggtattgcaagtgattttatccccgtagaataaataatttttatcaccctctgtgtttacagttatgtcattactaccacaagggcaagtcagccaaccaacaacaacgatatcttttttcataatccctccttaagcattcagttcgttgttgagttcgtaaatctcttcttgaagagaatcgatctcttcctccaaacgggagatctcttcttttagatataccatttcagattctttctctcctaactcattttcaaattttactttattcgcctcattttcataatggagttcagcgtaatcatcgcgcatttgttcaataagatgaatcagagacaagatgtaattatctcccgtttcatcacgccactcttcaccgtggcggagaacggtaattcgtccagtatcttcatctaaaattgtctcatatttacgatcatctgtataaatctgcattatttctccttattgaagtttaagtgaaccacgaagacgcttctcttgctgatcacgaatatattgtggaacctcgtgaattgaatcattaccgtgcctattttcaacaactaaagagataacttgataaccaaactcttcagcaagagctagataaggtttaagttctttctctgtggttgaagtgttagaaacaataatcttgttaagattagatgccatagcatcacgaacaatactctgacaccatgcgtgtgctttacctacattttctggcttccaatcgtaaacaccactttctgtgtaatgatattgatctgcctcacagataggccaataaccttcagaaataatttctgctactgtagatttaccagcacctgaaacgccacgtaaaatgataagttgtttcatttatcctccaaagaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccgcgcataagaaacttcttagtaagatagtatggtgacttaatctttaagagtaagttaaacggatagtttgtttcacgaactacaaacccttcgtgtttacaatctttagacatttcaacaacatctgaaaacttaaccatcggatgaacttcaggacgcttaaatttggtgacagaagcaattccatcaagagcaccttcaggtaacataaaacttgtcccatcagggttttgaattctggcaccaattaagtatgcacctggttcttcttcgacaatatgcggatcagaaggatcacagatttcaaaaaggaaagttgcttttgcactttctgtccatttgatgaagtgttctatgtcatcacactctgaaacaatatgattctttgcaatacttgcaaaatctgattcaaggcttcctgttgtcgatacgataagttgacctttatatacacctacagaggccataaaaccatttactttacgaacaacatctacaaattcatccgctggtagatctgtgccattctcaaaacgattaaaaatcttagtgaaaggccaaataacaacattgtcatcagcgtcaacaacgattccgcgacattctagaagacgagaatcaatgttccataggttatcccagaaaactttgttcttatacttaagaacagatagaccagaatactctccttctttatatgttttcttatgaactaaacctttttcaactaaatcgtcgcaattaaatttagccacattactctcctttgattattttgtgatggtctacagttacgatatctcgtttactcatcatagaaattatctcatcaaaatgtaagatttttccgtgtgcatcccaacccacatctaacattttaccataagcttcatcagggaaagatccgtgggaatgcccgtgtagcatgattgatccacgaccttgcttattccaggaggccatagggtaatggcttaagacgaagaacagcttctgatatttcacttcgtcataatacaccacttctccatactctgcaagcacttctcggtgtttgctgtaatcatggttcccaacacaataagtgatatccccttggaggcgggaagcaatcttacgggtatcttcttcagttccgaaacagaagtcacccaaatgccacatcttgacacctggactcgtagcgcatttattccatgcttcgatcagtgcttctgtcatgtggtccatatcttcccacggtcgatattcaggagcaaactctcgtatacgtttgtgcataaaatgcaaatcacttgtaataaacattagtataatccctcgctaaatagttcatggtcgtgaccattacgctcatggtcgatctggtcagcattttccgcgatgatataagcatccgcacgactccaccaattgtaatactgatcgataaagccttgattatctggtgtgcacaaagttttgttgattacacctgcttctttcaacacgtttaactgtgcatatagtacaggatttgcatgtcgaacacaaggaataattaactcttcaccattattcaaaatatacttatttgcagcacagacgataacacgttgcgcataatgaccctcaccaatccaggtaagaggttggtaacaaatattgttttcaataccactcattgtttcctaaccctcctctcttaagttatcctcgaaaaaactagtatctggaagtaaaagatcattacttgtgtcgggccaatcctcttcttctcggtagataaagtaaccttcgtcctcttcttgttccgaccaaaccgaatgatgcatgttctctccttaatagtgcacacgaatcattttaataccataacgcagcatggattcttttgcaagcatgaatttatccccagcggcgggattagaagtatgcacgaaaatggtaggtgaaccaaagcaaggtttaccaaacgccagaagttcttccaggtacaggaaaacatcatacccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttacgcatatcatctatccaaactttcatataacctcctctaagctggcatgattaaaaaagaactctccacttcaaaatgccaatcctccacaagacctgattcccaatccttctcttcatggaaagagcaaatccaacggtacatacctggcggtgtattctcaacatcttctggcaacccgtaatccaaagctgtcaaaccgttctctgtaaaactaggatggagattaggagctttcaatacagaaaccctgcctccaacatctacagccacaatccactctgtcatgtatgggctgtcatattgaggctcatcagaacctacctcaacagcctctgtgcgtaagatgataagaggctgctctgtgattggggctttgacaatatacccgtgatcctcaaaaagatcgataacctcgaactcatcgccgttttcgacaccataactcttattcaaagagataaacttcgggttatcatcgtaagctttatttactttaattctcatttttcctccttcactttaacctcaaattctacaggcttaccctcaatgtaaaaacactgatactctgccttatcatcctcatcacgaggccaagttaccaaggagttatagcaatcttctggtgctttgaagatggttttagtctccacagtaacattcccattaagtgttgccaataccacccacccagctacagggatcatagtgcctccactttccacgttttacccttatcaaccaaggtctttgctacagcatactccttcccattaacaaggaaataataaacgataaaagatttcccgattgttactgtcttagtaacctctacacgtttaacaccttgcatgtattttgccttaccggaatagagtaaaatcattttgcattcctcttgttgttgataacatccatagcagtatatggtttattagtgccatgatactccagaatcattggagagccttcttgcactacttcaaagataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcatccctcttctttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcaatgtatcaatccactctaagaagtgttctttcgcttctgtgtagttctgtgtgcctttaacaacgtgtataccatctagtgttacacggaataccatttgaataacgtctttcatttcttacctcctttgttgtcaaagtagcttaccagaacatcgtgaaccacacacatagcaaaaatcagaacaattgttgccaggattgggttctcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccactccaaatactcaaagccatccaaatgattactcttgtccaacaggaatgctatctgcttccattcaatctgaatatcatttaaatgatatgctgcacagaagatatcctcatagtaaaagacgatcattgtcattgcttcgtcaagtacaactacctcttgtcttgtaaatctcattctagcctcctaaacgcgtctctgacgcactttttatatataagatgataaatcaccttacctagtaagtaaacttgctctacagcctcttatgaagcttatgttataggctatactattgctacctgtttaagcaaggtttttgcacacagaaaataatttttaataaaactcttgacttttgtgttcgaagtatgctaccctagaaatctattaacgagcgcagcgagttaaggttttaggttggtgatgtagtactctgtactcaagtactgtactccgtactagattaataattattaaatattaataataaataattattagatctaacaaacaggtacagtgtatcagaactggtacgtacagatcaacttctatcaattaaaaataaaataataaattattataaataatacttgatctatagattagtatgaagtacagtacgaaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagcttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagagatggatcttgaaattaatacttttaacgcagaagctttggttgttgctcttctggaaaagaaagatagtgaagaagtagcagaatatgcttaaataactattgacaaacgtatccttcatatgttaggatacgttcatcaagtgtggtaacagggtcgttgacttttgttaagaggggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacggggttggtggagtcaccattcatggtaaaatgttttaaaaaactattgacaactaacattattttatgttagattataagtatggaagggcaaatcgacgtggcgacgaaaacggtcttgaaaaccgccgagcttgaaagagccttgggagttcgactctccctccttccgccagattaggtagattggtgaaatggtagccacgacagtttgctaaactgtagtcggaaacggcgtgtaggttcgagtcctacatctaccgccaagttctttttaatatagcttactttagcagagtaaatcttcggcaagtggcggtaaccactttaccgataactcatagttagtggtgtgaacactggctattttaaaaagaatttaaatattagtatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcaaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagagtgggagcaccaacacaacattaagggcactgtgattgatcgtcgtatcctgtgcacaaggtctgttcgaaagacagtgttcttagtattgtgttgatcacacaaaaagagttacctgaaacttgaccggagtagggttggatggggcaaaagaagaagcggctctcccatcgacagcaacgaagaataatatttgactttggttttgtattattttaagttagcttaccgaacgtagggctagtcacccaacgggatactcgtcactgtcccactcaataaaactattgacaaccaatagtaaaatgtagtatagtaaagatgtagggcgttcttggtgtagcggtagcattccgtccttccaagtcggcggcacgagttcgatcctcgtagaacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacaaaggtgagtcactacctcaagtgtgaagttaaaaacgaggagccgccgaacactttcttttgcggtgtacctttagaatgttatgacggaatttagctcagtttggtagagtgtacgctttgggagcgtattgtcgcaggttcgaatcctgcaattccgaccaattaaatgtttcgtagttcaatggtagaacccacgactgataatcgtgagatacaagttcgattcttgtcgaaacaaccagtttcccgttagacttacaggataagagttccacaatttattgtgacgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaacttaacagtatttattagcctccttattggaggctttttgctatctattgaataaaacttgacttattattttttatatgttaagataaagtttaggaggattttattatgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaacccctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattatatatcattttgtgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataaacaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttctaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggaggcagattagtgaatattcgggagaggatatttaccaatacaatcctaagaataagcgtttagaattggtaacaccttattttgtagaatatgatttaaatggagataacctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccacacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacacaatatgaaatgctctatcttctgggacgtatgcgttcagagtcagaaacaagtttcatgttgtgcacatgtaaccctgacgcagatagttgggttttgaattgggtgttaccttatcttgatgagggtggttatcctagagaagatatgtgtggtaaacaaaaatatttcatcattgttaacgatgaacctgtttttgctgacacacctgaagaactgaaagaaaaatatccagaaaactgtttcatggaaaaccctaatacaggggagacagttgttattgaaccacaaactttcgtatttattggtgggacaatatttgataacccagaactcattaggcttaaccctaattacttagcacagcttaaatcacaaacagcgattaaaagagcacagcttctggacggttgttggtttgcacgtattcagaaagaatctttctttcaacgtgaatggttacataaaatatcttataaagatgttcctaacaatcttaaactaatgcgagcatgggataaagctgtttcagttcctacagaaacttaccgttatccagactatacaacatctgtcaaaatgggtaaagaccaagatggtaatatctacatctttggcgactatgattatgatgctgtggatgagaaaagtaaaattttcggaaggtttcgaagactacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcctcttgttttaatactctgtcaaaagagaatactttcaaggcagtagctatccctacaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaagaacgtacactaaaaagtcagaatactgggacaaaggtgctgcaaataaagctgctctctctccaacaaaagaagcagagaaagagaaaacgttactcctgtcacctgaaataggaacgatcggattaaactcaatcaaagcatttacgaatttcatgcaaccctatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatacgggtttgcattcgcagagaaagtttatgagttggatgaagatcctaaaagtccttactttgggtattggcgattgaccaaattggcttttagaccacaagacactcttcacatggctcaaccttttacatattcggcagacggacgttctattctatctgttaaccagaatatcaccaatacgatgttagctccaggtaatacaactttagaaacgggtattaaagaaattcctttcagtaaagttttatttgttggtagcaacattacagagaataacccattaggagttagtccgctgttagctgtatatcgtagctggcgtgaaaaatctcttattcaggaatttgaggttattggggtatctaaagatttaggcggtatgccagttcttaaggttccaagtgacattctaaacagggcatctttagatcctgcgggggatgaagcacaatctcttcgagttctccaagccaacatcgctaacctgcactctggtgagcaagcctacatggtgttgccttcagacgtttatgaaggcacagtgatgcgtcaatacgatcttgtattccaaggtgttgatggcacgggtaaacagtttgacactcaagcactaatcaaacaacgtaaactggatatttataaccgctttggtgcgggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcagttggtagcctctggtgcgatacctttaaccccagaagttattaacgagtttcttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctctagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaaccttcgctggttttaaagagaattctgaatcccaacaagattctataccatctcaaaaacctgaaactctagtcaaacaaaataaatttgatgaagaaaagatgcaggttattgaggtcttgtattgtccacctgaagaagacgatctccacggagagcgcatgtctgatttggaaatcaggaagatggttgacaacttcaatgagaatattaccaacattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttctggaaaagctacggaagagtcactaggtgctcatattgcttacacttttgattttcaaggtggagcggcatctggttataataccccccttttatttaagtcagacggatctccagacataacttttgaaaagttagaagctctcactaaaatgggagaagatgttacagagttacgtaaaagctatattcaacaagtgatggatcgcatttctgaaaaagtgcgtgaaaaatttgaagctggttgggattgggtttacgttattgatgctgacttcgatgcgaacgttgcaattttctgttcagataacggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagacaataaagatatcgctgaaactatcgtcaaagcattcgaaaaagcacgtgcagaagtggacgcagttaagaaagaatttggaacagaacgtggtgttgacgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgacgatgtagcagtaggtgacactttcaccgcagttgttggcgtacgtgatcttactctgaaccgctttgcagtatactacaaagatggctccctggtagatgacgctggcgtagcagcactggaaacacatgatctgaaactgaccgaaaaagtcgttttcacttcttaattttaataggagattaatataatgccagcagtaattttagatcaggttgtagatttcagccctatgatcgaacttcaggattcccctgatacactgattgccagcctgaatctgttcagtgttgactatcattcaactaccgctattgaaatcggtaaagaaaaagctgaagatgctctgatctccgctcgtgagcgtggtggtgagcgtaacttcctgaccatgaaaaatccagaactgaaagcgttccgcattccgttcttccctctggataaaaacatcaaagctcaagatattcaatctttccgtagctttgcaatggcaggaatcaatgactctctgcgcacagacgctgaagttgttaaccgctatatgtcccagattctgcgtgacgtagcaaaaaccaaagaaaaaatctttgcagaagcagttatgggtcgtgcctataacggcgtaggtggtgcagctaactctgcatacaactggtataccgaatggggtgctacccagaaatctgttgctgtagactttgcttctaccactgtttctccagcagccactatcgaacaagaagctcgtgcttacatcatcgatactaaacaagatggctctaccgctacccgtatcgtagctctgtgttctcgtgagtttttcgcatctctggttaactctccatttgttcgccaggcatatcagtatttccagggaactcctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcaccgcactattcagcttcagtctgaattctcgctgctcgcagttaacacccgtccagaactggtagttaaactgactacggcttaatagaactctgttaatattagaggctcgtccgtgatgggcgagccttttctgtttacaataagagtttacaatgaggagattgatatgtcaaacccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacgcgtttgagagaagaaacaggtattcttgtgcatccttttgcaagtgaagaacacatgggttactatcttgtaagttacgaagactattcgcctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcgatgctgattcagatcatccaaacttggattgatattatagggaatgaagataaggataagtgtgcagtattgtggaacagcttgatttctgttttagagtatttatggaacaacgatgttcttaacaacagtactcaaacaggaggagctatgtcccgcagagaaaagatgggtgaagtcgaagttgaagttaaatttaacaacggtcaagtcacttataaatctccgtgggaagatatctatcataactatttaaatggtcttatggtgatccctgggtgcacggcaggacgaggagcaaccagcaaagttcttattggcggtgtggatgctcgtgagattgatcgagtaaacagcgatcctaactctgtaaatggtcttggtaatgttgcaagtgttgatcgtaatacacgcaacgttaattatttgcgaaattacggacctgtttctttttatcgtagggacaaataatggaaagtgagatcttaccaggtgacgatacagattgggaaaccattatcaaaaagatgatggaccttgaacaagttcaaatcgaggctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttactgaataatgtcgggttagctgtttttgagcctatagcgagagcctctaaagaaggaatagctcaagcgattgcaatgcaacgttatcgtcctttatctcctgtgacaattaagatacgacaagataaaggcaactattctaatcatatcttaatagatacggcacacatgataaatgcaatcgaaacaaaaatcacaaaaagcaagtctaaaaaataacttgcataaactttgtttttgatgtatactaaaaaggagatacaagtgttactagatcaatttactctccttgatctaactgaataccaaggtcgtagacgagtctacaaagaggcagttggttcagttattgctaacttagaaagtagtgtagaatatgaaccatttaccattgaagcggcaagcttacaaccgatatctggtaaaacactgaatgcactacctgaaggttacagatctaaggctcaatatagtttctggactaaaacagaaatgaaggggttacaacaaggaacagaacagttatcagatcaaatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacaattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattttaaacagggtttatgcaattactttggttccaggcgaatactcgtcagtcaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcccctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagttatggttggtaagcgtgaagttacaaactttactctaactccaatcgtagaagatagtgcaacttacacaattaccatcaaaaatggtaccaagaaaaaagaatttaaattcattgctgatgatactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatattgctgctctgcatgatattgatagtagctggttctggaccctttcagattcccatgaaacagaagatgttctagctttggctgcatgggtagaagagaatgataaagtttacttcttctctagttctgaacctggaattaaaacgaaagcagaagataacgttctggaacgactgaatgacctcggttataataacacttgctttgctttgtggatgaccgatgcagattctgtattcccagaagcagcagttgttggtgcaatctgttctcgtcaacctggtttaactactcttcacggtaaaacactggtaggtgtagagatcgagaaactggatcagacttcggaaaacaatattgttcaacagaacggtaacatctatcgtaaagagcatggaactctgttctatcgtgacggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgactgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggcgacgtttcactggctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttagatggaaacagatctgttactttccgtattatgaagtggagtccatctaaagtgtttgacaggattccagaattgggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttacggctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattggataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccaaaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagtcaaaaacctatgcgagcacctactcccgctggagcgggtgctcctgtaggcggatctggtagacctagaactcctaaaaccccgcaaggaagagaagaagaaaaagctcgtaaagctgctgaacgcgaagctaaagcagcagcacgtagggaagatttaggtaatcttcgtttgcagaactttaactacagagcaagagcatttagtaaagccagtcctggcgctatgcaagaagctagagacgttatgggtaaagctgtagagcaatacaaaaagggtgaaataactcttcaacgtatgaaccaagctcttgctcaccagttagatgccttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtcgatatggacaattaaaagaaggtgcagcaggtcttaatccacgcatgattgcatcctctttaataggtgctgggctgtttgcaggtggttctgtagttggtaacacgttgatgaatactaacgaaagaattaaacttgtaagtcgtggtgctgaaaacgttcagacaaacgccaacgctattttggcaatgacagcttggggtgaacagaacggtgtagactctgcaaatattattaagtcaatagataatattaaagacgttcgtgaacgtcttggtaatacagttttagcctcaaaatggaatgagaaagaagggaagtggaaaggcggtgataatggcataaatgacattatgaacttgtttggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataatgttaaagtgctagatcagtttgccaaagatttaggtgaagaactcggtaagacaacagttcaattaggaggttttgctaaagaattgggagatggtttcggatcttttaccaattggcttaaagaaacattcccagatacattcggagataacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttagctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataattaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctcaaaggctactcttatgattataaatctgaatttgctatgcaatttgatttagagtttgaacaaatccgtctcgtttctaaggccactactaatgctattgctgtaaaaacagcaccaaataaatcgactggtggtgatgtgaaaggtcaagttgcttcgaatggtcctaagtcagatattacagtaagaactgctgaagctactaataccccaacaaacaacggaggttaatagtgacaacttattctaaaacaacaaggtctacaagtaatacaggctacagtgcagtttatctagaggaccattctacttattttgcatggtatctgaaaactgaagagtatcctgatcaaacatatacagttacattggatggagttgattatgacattcgtttaaggtggaacactagggacgagtcttggcaatgtcagattggattatctggagatgatccaagtataagtttcaaagttacaaatggtttagatcttcttaaaccttataaatatcttgaaagtgtgccagatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctaccgtagatttggataccaagttaggaacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacattgtttagatggcggtattaacattgcagaagcaagaacaagccgcagttatccaaaaggaactaaaatcaaacgtgttgtgacagatttggtaaaggatttaggaactacagaaggtaatatacacgtagataatgatcaaaccttatcctcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctacattagccctgaaactggtctgataggaagtccagaaccattccacaacgatataaaacctactaaaaaagttaccaagtcatctaagaaggcaaagaaacctacagatggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattaaattttgtcacagcaatgcgtggcttaatgacagaacaattagcagaagtccatacagccctgccagtccgtgtgactggcgttaattatggtgctaaaactgtcactttagaatctattgttaaaaacacacgatctagtgaagatgaaatagattaccctacttttgaagatgttccttttatggttaatgggggtgggacaggaagaatctcattccctattaaagctggcgatttaggaactgttatattttctgaaagagatccttctaatgcactgcaaactagtggagaaacctcttcatcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtggcagatatcaatggtcttaaaatagatcagaacggtttgatgacagatggtaatggcatcggattccatactcacacgcacacggttcgtaacattcagagcggtagctcaagtgccgagtccttaaaaccaacaggagcctaacatgggaatcccttttgacttaaagcttggaccaaacaacgacctcatcatggatgatggggatttggtcctcactacaaccagaacagaaattgcagcacaaactcttgggataactctgaacacgtatcgtggggagtggtttttaaatactaacttcggtgttccttacttacaagagattattggtgttgccagaaagaaagatattgtagacagaatatttttagcagagattgccaaaaacgtttacatagatacaataaacagttataaatctgcttatgatatggatcaacgttattactcaatgacagttatggtcacagttggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgctgttgagtggtgcaggggtaactagaaaccgtttaaatgcacgtggaacagtaactagcaccttggcattagatattagttcggcagaatatttttcagcaactttatcttctgcaacgtgcacaattagttttactaatattccagtagcaacaaatgcagttttaaactttactttagctttgcgtcaaggaagtggtgcaaataaagtcgtatggccttcttctgtaaaatggagttttggtcgttccccagttttgagttatcgtcaaggtgcaacagacacttttgagtttatcagttatgataatggagcaacttggacaggtagcttagttttagcaggagttatttaatgtcaagagttaagcacaatattgacaacacgtttcagttgattgaagggttggttcagtttttggaaagaaatactgggcttaccatagatcctacggttcagcattacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatcttgaatctgccgagaagtattggcaagcctacatagatcacttcttcgggggccaacctattcctgatcctccggctaaatatcgtcccaactggatcatcaatggtaaagaaccacgtttagcacattaccctctcacagatgatgggtatcctacgcacggtgggttcaaaggtagcatgatgacttggattaacggaaggactgttattcctaaaggtgcgccacactggggagaatacttagataaagcttggtttgctttcaatggtaatcttggttggaactctgttaacgcaacagtgtatgcaactaacccagacggttcaaccaactggaaagaatatggagatcagtgggacgttgaatggattatagaccgtctaggacgtaaagttgattgggatggtaacattttatctattggtcatagctttgcagaatatggaacagtacaacttaaaaatgcttctgtgaacggggactataaattcaactacgctacatgcaatcctgtagaacacggtggatatctgcttaagcgtaatgagatgtggcataaccgtcctgtaaacgttccggtagagttaggctatcaagataatgcttccgatgctgaaacgtggtggtgtgatgcaaactacttgatgtatcagatcacaggagagagaaaatactggctttgctggcaatcttctttattgttgtgtcaagactactcaaacatcgatatgtttgataaattcttccgtagatctacgacagcaataattccttttacagatggtatctcgtatgattactcatacccatctacagcaatacctaaatattctcgtgacgaattaggatacacagtaattcgccaagatgtttcagcacaaacaactctagaacaacaggcagtttggttcagagtggatcagaattcaaaacttcgtattgagtttcaaggtgtagatgatgcaggggaaggtgttcttttccgtccagagttagaattaagcaaaactaagagtgaaacagatacagttacatatcgttgtggcttacctcttggtgcagctaatatgactaagatggatatacctttatccagttttatgcgcactgaacctcctggaggcggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacatatcgttcatacgcagatgattttaacatcactattacggattccgcaggttggagatggtgggccatgttagaaaaaacaaattctacatgggttactaaagctttaagtcctgctgatttcaaattaagcacttggcaacccaatcataacgacacagagacaaaaccttcgtcaataaacctgactgctgttgatcagatcaacattgcattggattctgaacctgcaaatggcttgacaggggcaatcgatttttattgtgttaacgatatcccatctttgtattcttcagccgctggtgatgattacacaatgtatttcagggttacagtttcatctgaaaatccttatacagcaaaacttggagattgtacaatactggactacaaacttgacagtttgaattatactccaggaatcattccattttccaatattagtgatcctaacacagcattatatgacggttggcgtggtattccttacccaggttatcaatacccatccttatattgttttaaagggagagatattgactgggttcgtatgaacaacagtatagactttttatatgattcacaaatgtggttttataataagtttgcccctgtaatgcctgggccaatggcacaagcttatgtttgggatcgttgggatgctcataaatatggaaacaaaaatgagttcacaatgtatcattggaacgataaagcttgggatggttatgaagcacgagcattcttctgtgcgtgtcatacggtatacgaactaaagcgacaaggagccgaagttcctgaaaaacttttaacagtttgtaaaaactggatcaactacctgaagtggttccaagataacaacgaaggaagaacaccaacaatattttatcccaacggagaagtggctgcgcctgtagatgactttacaagtcacatgtctgcgctctttatggcgggatgtgctataatggggatggctggatatgattcagaaatccctaacattaaaatagtagcagaccgctgttttgaacttattcaggaaaactatattgttcttggtcctaatcacgttatgaatggttgttggagtgctgctcctagaccagacagtgataacggagtcttctttggcttccacgctggagagttgttacgtggttttgggttgtatgctttatacaaaaaacttaatccccaaaatgcattacctgttttggattcgagcaatattcctgcacttactgttttgacaatggcaaacattagtgtggacgttaccgagtaaggggtaaaatgaaacaagctatatttactgtcacgcgagacaagagagtaaatgcgagttcatttaactacacgactgttgacggaacagcagtcgctggtagagattatattgcaaaatcgggaacacttgtgttccctgatgatgctgattctgctactattgtggttgaagtatttgaacgaccaaagaactcaatagatcttaacttctccctccaagtttcagggattagtcaaaataacatgatggttgaaacaaccatcaattgtattataactactatccaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagtacagttgacaaatatgaccataaaggtgttgggtatttgcctcacacagatttaagttcagagaaactttggtttaaaatggaaattagtcaaaacatgccaggttttaaagaagaacctttggtgccgactttgactgtaactctcctggataaaagtgttcattatgtcagtttaggattctacgcttcagatatttcagaagatggtaaaacagcaacaataaagttagattttggtaatatcttttctggccctaataatgatattcctttggatatgagtgctgtagataatattttcttctctttgattacagcaaggtatgaagaaatagaagaggttgtacctattggcagtcaagaggcttggtttactttcactcttcttgaacctacctctggttatagtatgatgaaagtcagcaaccttgtccagcctgaacatgatattcgcatgtgcacatcttatgatgatatgtataacctgactccagagagagttatttataatacatatgcactaggttatcgtggaatgattaaccattacaacggaatgtctcactattatgagttctcatggaacggaacatcttgggctttaaatagatctgtcttcctgaatccagctacagaagcttggctaaatagtttccattctatagcgaacgagaagggttacacaataatgaactctttaagttttgagttgatgagcacagtttgtcctgttgaatgggtccagcatgattggaacgatgctcttgcagcaacagggtataagcctcctagttacgtgttgtctccaactattgacgaaggcatggaatatttgcaaaatgttattaacaaaatagcatctatttctcaagctaacaatattccagtcgtcattcaaattggtgaaccttggtggtggtataatacagcaagtaaaatgccttgcatatacgattacactaccaaactggcattcaacacagaaactggcttatttgcacaagatgcaggaacaatagataattataaaacaggaacgccgtttgacgaatattatgcgtttttgtctcgtaaactaggattaagagttacaaagtttgcaacagatactagagcatcttacccaggagctaaagtaacattgcttccgttcttaccatcgattatcggcaacggtttgatggagaaagttaactttccgtctgattactacattcctgaagcttttgatttttactgttcagagtgttacgactggcttctggaaggtaagatgatgaaagcatttgatgcaattaccataccacatgaaaaattaggttttgaatattctgatattcactatctttcaggttttgttccagatgctactcttgcgcctttgtatggcttcgatcctgaatcaaactaccgcacgtatctttggaaaatgattataggtaatatagtgttgaacgccaacaagtttaacggacttacacaatatatatgggcctatcctcaaataatgcacgattccattacggtagttaactctcaatcccaagttttctatatgggtaatgtgcctttgaattgttatttgcaagatatcaatcttaaacaagcaaatgttgagattgctaccataagtggaattacattagctactaaatctggagaagatttagtaacaacacaaaaattttatatataggagtaaaaatgtcaactacaattactaatttacccgaaacatcaaaagttaatgattctgattacctggttttagaccaacctgataagactgttaaaagcacagtttccaactttcttactgacactggggtggttttagccacccagttgaaagatacagatggtgctaccaagtatccagaacttcaaatgtcacgttggagagatgaaggtgatcctagaggatggggagcagtaggtgacggagcaacagacgatactaatgccataacacagcttcttgctgctatgcctgatggatggattgttgatgggcgtaatctcactttcaaggttacaacactaccagatataagcaagtttaaaaacgccgcttttgtttacgagcgtattgttggacaaccccttacttacgtatctgcgggtttcttcgatggaaatctgacaaaaattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgtatgagtatgggtgtatgtggtaatcgcttatatgcagtgatcgaaacccgttacttatctaacatgcgattgaagaaagcagaactttggtcacgtccaatgccttattatagaaggccaactggaggcataacaattagttctgggtctactacagcgacaattgttttagaaaagcatggtcttaaagttggagatgctgttaacttttccaattcaggtgcaactggcgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagatttatgtgttacagaaacccatagttttacagttatagatgatgataattacacttttgctgttggttatcacaatggtgatgtttccccaagaagattaggtattttgtatttcaataatgcttactctgacccaagttcttttactcgtagaacaattagtcaagaatatgctgacaatgcagcagaaccctgcattaaatattatgatggaattttatatttaactactaggggtacttcaacttctgctgctggttctacattagcaatgagtaccgaccttggagaaaactggaattacttaagattccctaacaacgttcatcatacaaacttaccatttgcaaaagttggtaactacctttatatctttggtacagaacgttcattcggagaatgggaaggagaagaactagataatagatataaaggcacgtatcctcgaacgtttatgtgcaagattaatgtatcttcatggcctacatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggagataatagtaaaaaattatggtacaagcatgatggtcatccagccgatttatatagttatagactaaagattaccgaacatgattttgtatcacgtgatttcaaatatggagctacgccaaaccgtacgttgcctgtatctatgggtacagatggggtaaggcatgtctcagcccctgtaacttttgataatgatgtacaagtatactctttaacagttactggccttgagcatgatgggacgcaacaatctgccgttagaataaaattagacggtgattatggggttgttgcaaaaaatgtcccaataaaaaatccttctgaacagcgactaatcctatgtggaggagaaactccttacgttacggatggatcgctattacaactatatggttcaaaccatacgtatccaaacagagcagttttatatgccccaggaggagcatatacccaaaataatttcatgccgtatttagatggacaagttgcattaggcggtgcgtctaacagatggtcagaagtgtacgcatctacaggaaccattaatacttcggatggaacattaaaaactaaacctacagagattgaagatattttactgaaagcatgggaagatattcatgtaatctcttaccaatggcttagtgctgtcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacgggacaaaaagaaatccctttatttgatgatgaagggaatgttgtaattgatgaagaaggtaatccagtaacaatcgtagaagatgttgtagaaactatcgaaataattccagcaggatcgcgatggggtatccgcgctgaccaaatgttttttattgagatggcttatcaacgtaaaaagttaaaagctcttgaagaaagacttgcaaccctggaaagtaaataatacagcttaggtggtatttcaatctttatatctcacttagaggtactcatggctaaagagaaaaacggttttaaaaaatttattcgcggaatgttctgcacttaccccggcaacggggtaagctctacgaaagtctggaacgctgtaggcatgtctgttatgacaggcatgtttatctttttaggaatagaaaaagaaattcctgaatggatgggttgggcttttgttttcatgataaccccttctcgcctcatgaaaaatcttattgatttacgttggggcagatcacaatctactaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcgggcaactgtttagaataattgcatacacagattacacattgtgggaaggtatgcaaggtgtttataatactcaaacactggatggtgcagaaggtatttatcttgacgaaatcttttctaaacgcggtttctatcgagcaggggcagcagcaagtacaggttatgcatatgttaagagcaataacaaagcagcttggacttatgagctaggcacggatatttacttcaactctgacagtgatatgaactactatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataacagatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacagggatatcttctacctttacaggttatcttgacagtggtaacttctattcattttctcctggtcgggatgttgagacagacgcagaattccgctctcgtttcaatgacaacgttgatgaagctaacgcagggacacgagcagctattgtgaaagctctgctacttacagatggtgttactaaggtgaagatttatgataaccctacattacatgatcaagaacatgctccagctatgactttccagactatagtttatggtggcagtgcagaagaaattgcaaatgttatctataaaaccaaaccaatcaacactttgacacacggaacaactaacataacagttacaacagaagacggaggacaagaaattattcgcttctctcctggtgcttctgctatgtattccgtaaaacttgtttatcaaactgtcaacggaacaactttaagtggaacagaaaaacaaaacatcgtagaagctctacaaaacctgcaagcttactttgagttaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagatgttaaaaaccttctgattgaagattttaaatcttctcctaacattgtcaagctcctctacatcgtatccagtgaaaagcaaaagatagatcaggcaatgatctatcttgctaaacaccgcttgatctccacagccacaggcaaatacctagatatcttaggagaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaatcagacctaaagaaaccatccgcacagttggtatggattatggtcaaatcatgacttgcgaagaaatgaactggattcttaataatatcggtttatggattcgctatttggtggatgactttcttccaactttacctgatacttacttgcctttagttggaactaagattacaatggcaggtgatgctactggtgaggctacttggaatggtaataaagaagttactttatctatccaagttcaagataacagtcataatcacttgtcggcaaacattacagatgctactagttcaacagtaacaccaaacgtgttggtaaaacgtgatgcgggtggtgctatttatggtggtgatgtttatgttaacggtacttccacaacagatcctgcgacactgtttttcaaaaactttgcaggacaaactaatggtgagatttctgccgaataccaaagtggaggtcagctttatatttatcgtagaaatcctagcacaggtagtgtatcagcaggtgttcgtttatatgatgcaggttatgttctaatagacagtccaagatcaaacagtggacaagatacttctaacggaaatgctttagttcgcttagattatctgaattctcgtttgacttctcttcagaacacattgcagacgaatattaacactgttcaaaacaacctgaatagtgttaacagcaacctctcttcccgtataaacaatgtagaaagtaatcatcaaagtcagattacaaacaactacaactatgctaacggaacctttgtaagagatattcgttacactagccaaggcgtgtattatccaccagggaacgaagtttcttggacttatatctgttcttctggttatgttctttctggtattattgtccaggaaacagggcgtagttctgcggataacatcggtggggtttatttcaaacgcctccagcgcaacgttaacggaaactggtacgatatcggaggctaaatgatatttacaaattttaaaagatatattcccgaagatcccgaactaaaagaattggtagaagtagagaacattctttttcttcgttgcgatcaaggttacgattggtatgatttacgtagcacagaattcaataacgataaaatgaaagtcgtttttgacgatcaaaatcgtattgtgttttggaacactgatcctacattactttgccctgaagatctttctatagcacaagtggactttaatatagacacttttgaggatattagaaacaaggttctggatttagaaactttgactcttaaggataaagagtattcccgcgaagagttgatgacacaagctagtgcaaaaattcgctctttacaagaaacagcggtagcacttataacacctttacagtatgctaaagatttagaaatggctactgaagatgaattagcttatcttaaaaatcttcaagtttatgtggttaaactaaaccgtgttccgcttcaaaaagactatccttacactatagattggcctacattaccaacggaataagggatcattatggaatttcaagaagcatggggacttgcaaaggatgcaataatccctttaatcggagtcatctggttctttttcaaacaaaaaatggataaattcggctctgatcttgatgaaatggaggagaaaagtcgagagctagagaagaagttggtctttgttgaatcaacttatgcaactaaagccgaacttacccagatgctaaatcaaattaactctacattaatggcaaataataacactcttgagcaaaaaattgaaaagattatggacctcaagaatgcgactatccaaatgatgctagatgacatagttaaacgtacacagaataaggggtaattaatggcaacattcccaacgtatccagcaacgtctcttgaacagggcgtagatctggttattttctcgtccaatcaacttcatgatgttattaatggaagtgcgacagaaagtattgagacagaatcagggttgataccaaccctgagaaaagcccttgttgataactttttctttaaaagcccattggattgggcgcaaggcacaaatgaaacggtttttaaccaactacgttattttcagaatggggtattgagcggttattattatgctcctaatgctacattggtaaacccaatccctatgcaaggtactccagtaggagataacaactgggtattgtggggattgaagacagaacaattggcaacagaagtcacaccttgggtatattctggtgcaactggttatgaaacagtaatcagtcctccttacatctttgatagtgctattgttacgatcaatggtgttattcaggttctgggggaagctttccgtatagaagatagtaagatcatcttatctgaacctttgggacacgatcctgcaacaggactgccaaacaagcttttcgcttatattggtaaaatcgtagcttcagcagatacagatcctaatctagagaaccgtcttgttagtttagaaacaaaaacggaagaactaacagaaagcatggataaagtccctctgcaaactattgctcgtaaatatggtttgttagatgatgaggtggcttacgcaacagcaggtcaatcgttaacagggattaaagctctgtatgatccggtagcacagtcttcctacacattacctcctaacatcacaggaactttaacatctttgtctgtttctggagtaatgacttattctggagggtctgtagatctttctgcactagctgttgaacgtggacagtttgtccatttgcctacaagctttggtaataatgtaactctgacagctaaaaatcagacgattggacgtggtgctggtcgttatcgttgggctggaagtttaccaaaaagtattttggcctctgacacattagagacaagcggtggattaggtccaaacgcatgggttctaactaatacggaaggactgttaacccctcgtggtggaacatacaacgatttattcgatgttgtctacttgtcagaatttgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgcggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggggaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatctctatcgaaaacattcatggcgatccagaccagaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggacgaagagggtaatccggtagttccggcacagggtagaccttcaaacccatgctttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccagggacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaacgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatcccattgtaacgcctacaagtgctggagttagaattaaaaccatacctaatgattccagtaatgtttctgtaggtaatactgcggttattcgcccaacgccagtagtagatgtgccaacaacctaatggaatagagggggaatccccctcttcttccaatagaatggtctaatgataggagagataaatgaatttaacaagacctaatagtgcgatagccgatctggtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcaatgcagcaacaaattgatgatctgtcggaaacaatacctgaagctggtaaatcggcttatcagatcgcacttgataatggttttgttggaacagaagcacaatggcttgcctctttgaaaggggatactggtgctcaacttaatattaaaggatcgttagcaagcactagtgaactaccatccacaggtaacgttgcaggggatggttatatcgtaggtgatgtaatctacgcttgggatggttctgtttggaaacttatttcttctcttgggccagaaggtaaatcagcttacgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaacgggacagcttgggtcaacatgggtaatattgttggtcctcaaggtccacaaggtgaggcaggtaaagacggtcttgatggaacagatggagatgaagggaaatctgcatatcaaagttggctggatgctggtaatgaagggacagaagtagattttattgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggcgatgcatataaaattaataatgatttgtatgtttgggttcaagatgctacggaatggatgaatgttggcagtcttggaggaatatcaattacagctaaaggtcatgttccgaacagtgaagctctccctgtttacaataactatggtgatgcttacttaactgaagacactagtaatctttacatctatacttacgatcaagacaccaattccgcatcttttgttgacatgggaagtattaaaggtgacaaaggtgaaaaaggggctaaaggagataagggtgatcctggaacaaacggaaccaacggtactgatggggccaacggtaaggacggcgcacagtggtttgtagcaacaactaatccagtcgcaggagacggtgttatcaatgattacgccttcaatactaacactggagcagtgtttaagaaaacagattcttctacgtggacacttataggaactcttcctagtataccagaagcccctcaagatggtttgacgtatggtcgttctgatggaaactggatcgaaatatcaggatcagatcctacagaagctataacaccgactagagttacagcaggtttcatggaacttgaaacaactactgccaactctggagcatcttggactccttctggaacttccaatatgtatgttgttacagtaactgacgctctgacagttggagcatggcctggtgtcactggctctacaaaacctaaagcgttttcagcaatgatttatttgattcaagatacaacgggacacacggttacactagatgcgtcttatggagcactaaatgatacagaaatagcaactactgctaacgcagtaacaattttgcaattaacgtatcctggtgtgggtgatatcgtggacatggttgttgtaacacgataacagaagccccgaaaggggctttctttttatggagggtttaaatgtttccaattccaatatttactattatgaccagcactggtgtcgttcctctgccagcaggtattgttaaaaaagtaatcactttagattacccagataatgctggtaattctaacagcagtttagcaattttgcttaatgatggtagattgtttactcaaggcgcaaacctttttggtgagattgcagatggaactcgtagtgcacgattcaataatttccacttagcttctactgtagtagcggatgtgtttaccgcagatcgttgttttgttattaaaactaacagtgggggatggcaatattcaggattgacagcaggattggtaggatctatagcagcaggtggtacggacgcatgtgtaactacttggaccagctttccatctgtaataacagggactatctctttagccaatcttaaagaggttaagggaggatataacaacactctctggttaatgaatagtggtgttctttatggatcaggtcaaaacacagtaggcagtttaggtgcaagtactactaacgaagtttctactcctcgtcagataacaagtgcagcagttgcttttgatgcaggttacaaccaatgctcttatgtcaacaatgtgggaaccttgcgtgtttgtggagctagtaaaggtttagcaggtaataataacacaacaacagcttttgtcaatgctaagatatccgctactgaaacagtgtatgtcaaagattacatcaatacagtttcccagacaatagttgtaggagatacctccggtggcacgggtacagtaaactacttatatgttagatctaatacagaaacaacctacactaaactggatacctttgcagcaggtttctcaacatggaagtttccaccaagccgccactcttttttcgttgggatcaataattccttgtgggctattggtaagaactacactgcaaacttaggtttggggtatgattctgcgagcggagatccactccaagtgggaaaaccagttaaacctgaaggagtgggttcttgggatataaacaagctcacaagcgttcatacgctgaatatggatgttactaaccaattaggttatcaaggaacttttttcgtttataatggggatatgtattattccggtatttggaaagatgggaaagcctcgtatctgttcaatagtggtctaaactataataaattcacaccaatagcaagctccgtgattacgggtgatattctggcaactggcttaactacagattctttaggaatttgtattgtaggtggaactaaacagttgacacattctgttagcccagaaggaggtaaacttttcaatattaaatacacttcttctgcccctgcaaacatgacaatatcatctactggtttaatgactttccatgcagaaggtggttttgatgcaggtatgacagccttaaacgctgaaggaacaaccttatcagatacctctggaggatatgcttcaacattgagcgtttacactcctagcttatctgcgatggatgtaggaacaacacaaacaatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacatatcaaggtgttgttaccgcttctgatagttcttatttaacggtgaatgctgttgcgggaaaggagttagctccatctccgagtagtagcttaacggttctaaacggatatttcaaccactcggcagatggggcaattacgttcccaattttatcgggtactgtcacaccagctaactttgtagttaaggtggatgacgttgtaataccttcaaataaagtaatatttagaaataaagctttctctacagtggatagttatccagcaggagaatatagactggctattgaatttgcaagtgcttcagtagtgaatagtgttgatgtgtctatggaagcaaatccaaatcttttagaattatggggcggcaacagaattggttattctacaagcccagcctcacaattcttaaaaggttgtgctaacttaagacgaataacttctgattgttttagtaacacatcttacaccggaacatctataagtggtatcttctctggctgtacaagtttgacagctatccctgaaggattattcagtgatgctttatttccttcactgacaacaatgtcaagcacgtttgaaggttgtacatctttaacatctattccttcagatttatttaagaatctatcaaaagttacaagatattcttacacctttaaagattgcacctctcttgcagaagttccagcaggaatgtttgataatattccaacgaaagtgacctctttaacagctacattccaaggttgtttagcacttacggattttaataaaatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccaattataaataagaaaaggagccatttggctcctttcttttataaaaactctttataaatcaataagatcagaacggaatatcatcatcgaagtccattggaggttcttcttgattacttggagttggttctggttgtggttcaggtttcttaacttctttcttctcttctttcttaggctgttctgcggaaccacgaatggcagcagcaactttatcagacagagccagaactttacgagcagaatcaatcagatcttctacagatacagtcttaatagtatggtctttacaagcattgaggatagcgtgaccaacagatgccccaagatcataatcattaatatcaacgccacgagattcagcaatttccgatttcagcgtgacagttgcagattgaacaaccccagcgatatcgaaagcatcgcctttaacaccattacgaatcagttccagtgcaccatttactgcgtgaccagtttccagacctacagtatcacgttttttataggattgcttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcgccttctttgacttgcaggttttcataaccttctttcagttcaatgtcaccaagagaaatccaaacacctttctcatctggtttagcacctttctctttcagaacaagagaagctcggtgagttgaaacaatcgtttttccttcccaatggaaggttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgtcaaactggtatagtttccataaacagtttcaacagctatcttagaacgttcaatcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattgtcagaagcctctttgttccctagtttacgaatattggttcccattaaagcagatgcaattaatccttgtatttgttcttcagtccgatgtgcaggaagggatgtatagaaatccagatcacgtccagcaatatcaagaatacgccaatcacgaacagcaccgccagccaagacagaattaggatcagcgatctttaatatggtaagaatttctttggcaatattgatttgttttgatttagtcattgatacgctccacagttacttttacaacatcgtccatattaatctcatcccctaagacctcaataacaccttcctcataaagtcgagcacattcttcccacacttcagcttccgtcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataagacatatctttaccacaagaccaacaacggatatccccatcgtcccattcacgttcttcttcaccttcgaattcatctggtaggtaaggcataccaagacaatctaaatcgtaatgcatatctcctcctataaaggggcagaagccccttataaaacaatatgttagatcagtgacaggacgcccaagaattacccacatcatatccggcagtaagctgaacattaagattgtaaaattctccagccttagtaacagctaaggcagcaagttcacctgcccgactataggctgtaaaccatccacctttaggagattcatgaatgttagcccaaatttgccctgtctctttttccttattatgcttccattcttcgactttagcaaggcattctttatcaattttcttttgttcttcaggatcgtctactttcttccaacctaatgattcaggtgaaaaccatttaaattctacaaggttacgagaaacttcaagctgggcttcatcgtgatatgcaatcatttgttgcacgaaatctttattcttccagtcatctttaaagaagtcaacacttagtccttcttcttcgatcatgtcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccgatagtttcagtgatacgttttgccatcattgtgtgaacatcattaggtttctctaataacagagcgttacaatattcgtgtggctccggctcgtaccgccaacagtagtgtgattcaatttttgcttccaaagagtcgaagtcgtagccgatctggaagtatttaggaacctctacaccaaacaagttacgcatctcccatccaaacaaagatgtgacacgaggaatattagctacagatctatgcttcatacgagaggttgcagcatcacatgtagcggctggggtaggaatacgcccatccgcccttactgcggctaagaaacctttatcgtattcttgatcttcttcatcttcttcccaatcagcaccgccacctaaaatagagttcctacgatgcttatacgttaagtattctacaatctgtgtagcataaggaaacttctcacccaaagcttgcaggttaggacaaatttctttttcctgacctttggtaaaacatgggttagtcaatactttaagaccgcgacctttaccttttgctatacgctcttgaatcttcctttccagggtttccggtgtgcactccagatgatcacaacgatcctgacaaaaattagaagatagagtttgctcaacgtaagctcgaatacctttctgaagttcttcctcgctctttttaatcttggtgccagatttaagagtcaagtctttatctttatattcagacggtacccaacctaatcctacaagccagtttttaatatgggttgtatcgttcaatgttgcagggatgttaggatcacacagaggctcatctgctgcaactggcagtttccactctttccccaacataactaaccaccaatcgccatccctctcttccaaatgaccatcatgtttcttagcaaaattgatcatatggttagttggctctaagttctttttaatttgcaacttaggtggaataaaagctttaagataaccttttgttgctggtttaggtggcaaaataggctcaacgagtaaacgaagacgctccatttctgcatccaaaaaagcaaggttctcttctgcttgtttcatgttaaaagcaaacccacggtgttcctggcgtgtaataatgtctgctacacgttgttcaagttcaaatggaccttcccatttatcataatcaccccattcttccataaggtaattatatacgctcgtattggctttgttgtcatagatacagtaataaagcatatccgcagcaaaagtcttaaatcgatcttcttctggaatctctttacggaaatctattttcacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttgtctttaaaataaccttcatgattaataaaatctgggaaatcttttagttgaaaatgtgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcctcttctgataacactttacctgcacttgctcccgctctcctaacggctatgtcgtagtctttactgttgcctaatacgaatagtcgattttctcctaaaacaacaggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaacggaggattaccgacaaaagcagttacactaccaacagactcaacagattgagctaaaaaatctgcctcaatacaatcttcaaacttagggtcaatatcaaaagaagttatgtttttaaaacaagaagagaaagccccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcgtcagaaataaccatgtttttggtatttttaaagatgatatctactttaccttcacttacacgacagaatgcaacaccatctgcaactttatcgatataatatttgtaagaaagaatacccactttactacgaccagcaccttttgtgaaagaagggcttacatcgaaacggaaacctttagaagaaacaacacggtaagaacgtccagttggaagatgttcaataacagagacattattctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtctcttccgtaaagttgtcaacaggtatttttaataaaagggccgaagcccttaatagttgctatccgtaggcaaattagcaggattgttgaaatactgctctttgtcatgcagagttgcagttctaatgtcatagtaaaactgccctgccggaccagtttctgagaactcacggttttttaggataaagcaatgagtcgtattgcgttctacagggtcttcagcggctttatctcgttccaaagccaaggtaataccagcacctttagccaagaaactactacccattgcatcgtcctctgttaagtgttcattgccaccattagccgatttcttaacgtgtgagatgacaataatagttatagcatactctttcatgatgcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacataaaaacgtggtgatccatcttctctttcgtaaaaatctaggattttttctttattctcttccaagatttgaaatttctcttccggtgttttcctgtgtagaggaatatgcaggaacgaggacaacaggttacgagaatatttcttataagttgcttccaaggacagaatacctagggtatgttctgggtgcgcaacaataatatgtttggtgatctcgttcaccatcaaagttttaccgatactggtctttgccaggataactgtaatctcttcctctactaaaccaccacccagcatgtttgcagctacacgcataaaaggaggcaaggtaatcatcttggattccaagcattctaatgcagcttcatacaagacattagaagcataaacacctgctggggtgtatagacgagcactccaaaaagcttttacgaaatcttttgcacgaccttcttccagatactgattggcatccttaagatccatctgcatacggtagactttgttacgaggcagcaccttaacaatattttcaaatgcctcattacctgctttgtcattatccatgcaaacaataatcttcttaaatttttcaaagaaaggatattgtgcctgaacttgtttatacatactggtttcaccagttgtgccactaactactgctggaagctcatatttgttgtccaagttttcagacagcatttgataagctgccagagcatcgtgttcaccacctgtaattaccacagtgtgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatccccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacccttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagagccttcataaaaacgaataccgtcaattaaaagccctccgtggtaatcccaatcactttcacgagaaagcgggttaggctcttcataatagtaatccacctccacgactaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagaacagatcaaaggtaaacccttagcacctgcctcaagaattttaagattgctttttgcattattaaacacgttatcaagcaatggcgcaagactgatttgatgaccatcgtaagattccatgtagttggcatatggtcttacaccttcataaacacaagttggtgctacattttctctgatcacagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagaccattagggattatgtgcacattatcattgtattgtgaaagttcaacttgcaaagcaggtgtcgtagttgtaacaagatcgctgtgctctaaaaaccattttaaatgttcacgaatacctgattcaaaaataccttctaacatgtgtccttttggaataactaaagagtcatccaaatccataaccattttaaagcctaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaactcgtttgcatctgccagattataatgtgttcgaacatgttcagccaagaacaagccacgatcttcccgatagtttggattgcgaagaagcttaacaatttcgtaatgccattctgctttattctctgcgtaagcaacagcgcgagcatctacagggttaaaataaggtaataccttagaacaaacaattggaataccttttgctccagcttccaggattttgagattacttttacaattattaaaatcattatctaccaaaggagctatagcaatagcatgactttcgtaaacactcatgtaattatctaaatcttttacagcggctttatatttggcatttggtaaatttctgcgaatcttaatccactcttgtcccgtgatgctttgtgatgcttcatatcccgcaatagtaagaagttcatcatcgaaagtattagagactagtcgtaagtctggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaattaccacatcagcaagcttaaccatagctacaatagcatgagtgtttgactcgtatagacttgctaaataatgttctggattaagttggtaaaaatcatctaagtctacaacaaccttaacaccttgacgtttcaaagataaaacgtattctgcacctttagagtggatacggttaaacacaacaacatctttcttaggttgaatattattgttgttaaatggtataacaatacgatgatagtcacaaccgctgtgaggttttgcatcaatttttagtttagaccattttttatttgacatgtgctagtgcctcctcataggaaattcggattttcccatttttaatatcctctaaagatgctttatattcttcccagttaatcccaatagcagcctctttctcttcttttgtcaggttagcaaaaggcataggattgtttccaaaaacatcgtctgggtggatataagccatgatacgaagtggacaaggtgttgcctgaataccatgattcaaaccagcagcttgcaaacggtgtccccattcagcatcttcaaaaccataaccgtgagtgtaaggacggaaataacccatcttctcaacaacggcacgagaatacattgcaaattgacacattgcaagttcccagagaataacttctcctttgcttccaacaactttatctttgaaatactccggcataccaaagaaatcccatcctccagagacagcttgatctacaaagtatgtttcccatccctccatgactgggtagcaatcatcgtcaaaaataaaccaataatcataaccttcttcataaaactggtgcataagttcattcctggcataagctacacctttacgatctggatcgttgaatactcgaaaatctgcacgtggatctgttacaaggtagtctttaagtggacggacacctacagtgataacacccactccgattttaatattttccattttctctcctaaatagttttactgtgatcatgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacatttactttatgatattctcttgcaatcttagcatattctatatggtttagaatatctggatcatcgttaatttggttagagaaaagttgataaccactgcctaacctgttacaagttgcacctattacatcaaaaggcgggtttgacataacaagctcttcaagcatagatggttgatcaggtaggaggaacattgtatcggtatctcttaaacacacccaactatcatctggaagaacggcaatggcttcattgatagccttgccgatatttcctgtcagatagggagtaatataataaatcattctcccctccgttatattaactgtcagctacaatcccacgtttaatcatttcttgttggatttggatcacacgatctcgtgcttccatatattctttaaaagattcttggagatggtcacgggctacgtcccgtagtttaatcagtttgtcgtttgtcacttcttgaagagagatctcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcagtgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatctcccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgttcttatattccgtttcttgaagtatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttaattattacggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaaccagatgacgtgcagacagcatttcaggattgccagcggcattgtgacgacaaaccagtgcacttacatccagatctagtttagaatcagatttccaagagaattccaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaatgccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtctggaagaatacaacaccaggggtaacgtcagcacctggttcagatacagctacaactttttcacgctctacagacactgtttcagttttaccaagcagacgattaaagaagcctttctttggagcctcctcttgtaccacttgtttagtggtaatatatttagtaacagtgccaaaatactcatcgtagatatccgccattacaggggcgtaatttgttccacctccgatacgaacattacgcatacatttaccaacataatcatcgtaaacatctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcgttcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacagatcgcactgtttgtggaatttttaatgaacaccaagttacggtaggtatccaaccctgcgtcttcataggcatcataatacatgaatgtggcccctacgtcaagatcttcgaaagcaataggtaaatcctgacttttttcttcttgaatattgaatctaaacacgcatacctcctctaccaattttgaagcccaaatcgtaagcttccttagtgatcttttgtaactcacttataggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttaccccaatccatagcccattcgaaccgttcacgaacgccgttttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaagagtctccataagttttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacacccaccgtcatcatctttcattacttcataaacttcaccacttgttaacttgatgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatgcctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctctatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcattcaaggaacgcaaggttgttcctgcctctgccccaatctcttcgatctcttgtcgggtcatagaaggcaaaactggaacttcttgcggtgccgctggtgcataaacaggactggcatctaacacgcttggagcgaatacagatttacttgcatctgttgttgcagcaaatacgctcatttcaggcttcttctgaccaccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaattctgctgccagtttttgccaatgagcaccgtgcctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcacgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagctacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgacctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcattttgactattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacgatcataacgcttaccccagggtaaacttttgaaagataatctaaaacgtaatccacatcaccagataaatcccaaacaagttcttgaatttcatcaaaattattcataagtctctcctataaaatagcctcccgaaggaggctcatctattaaacagcagcttcttctttttcagggaagataaagcttgcaataacaccaagagctaatgtgcctagaacaatcatcagacttacgttaggggaaatatcatgcgggaggaatgaccacttggcatgaagtgtttcaccgaacgggtgatacataagtttagcaccaacaaacaccagaaccacagcaacagctttctctaagtgaaccagatatttcacagctacacttaacacaaagaaaagtgcacgtaaaccaagaacagccatcagcattgcagaataaactagcagaggttcttgtgtcacaccgatcacagccggaactgaatcaaaagagaagacaatatctgtaagctcaataacaaacacacaaagaagagcaggagttgcatatttaataccattcttaatggtaatgaacttttcaccatccagtgcattgtgcacaggcagaactttacctactaaacgaacagcccaatgcttagagtaatcaatatcctcttcttcgtcaccacctttgatgatagccacggcagaccaagctacaatcaaaccgaacaacacttggaccgaccaatgaaggttaaacaaagcggtccctgctgcaacaaaaatacctcggaagacaatggctcctgcaatcccccaaagtaaaatcttatgttggagatgtgtgctcttaattccaaagcttgcaaaaattgccatgaacaccatcaggttatctacagaaagactcttttccaacacataaccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaaccaaaacaactacatcaataatggggaaaccaagttgcattattttctcctttctctttgcggggaaccactccccgcctcatgtgatacatcttactctattctaaaactttgtcaacacttattttgaagaacttgaggaaaagatcccacgtagtacagccatgataaatgccacacacaccacagtccagaaggtgacaggaacagtgatatctgtgtgacccatcatttcaacaacgtagttataagccagcagcagaagccatgctggaatcatactaatcagaaaagcaataacaaacacaataatcactgcaagaatacctgctaaaacgcccataatatttctcctcttaaagtttataaatagtcacatcgtgacctgtttttactaaagtttcttcaatcatcacttggatgatagcccaattacctccagcatgtccagcgccaatcataggtaagccgatcttacatttttggtcacggagaagcaaatcgttagccatagctattagtgcatcgtaaagtgcatcatagtccaactgacgacctttagcattgtatccgtaacggtattgcccgtatagattatataccaaagggtctgattgttcgtctggcacccctaaactaaaacaacctagtttactttgatcaccagccattgtgtctaagtctgctgcatatgcgtaaggaaatgctcgtttgatttgtggggcaatacctgcccccatattacacatacagttgcaacaatgagcaataacagttacttcacctgctttagcggcatcaataagattacctgttttcattttaagcatttttagctccttattacagaatgtgttgttttgtgtaacgatccaagaattcaaagttttcagcatactttgaaattcggttgtaaccttctcccaagcatccaaagaaaagttgctctacatagtaatgtggcaattggctaagaatgattttgaagtcttcatgattttggccaataagatacttaataggacgaacaagacactgtgcatcacgttcttcattaatcattttaacaaacgcttctggtgtattaatgtagttaaaattcagtttagcttcggtatctgcttgattacctccgtattttgcaaaatacaagaagtaaacatcatttttaacttgattttcatcaaggatctcaatcagtttgtcttcatgcgttccagtgatatttacatcatcaatgaatacaagcttcttatcaccccagaattctttgttgcagtagaatgtatccccatcaataagtttcttacgactagctttatccaagaaaccataatcgttgatatagctaactttacgatgaataatgtccagttctgctgaacgaccttgatcatattgtgattgcaacatattaaaataattaataaaatgatctgtcatcattgttgcagcattatgcacatggttataaggagaaggaatgataacaaattgttccccaatatgtttcattgccacttgagcaaaaaactgaagtgccaattctttacccatacgacgcgcagcttggttactaccaaatttcaattttgaataatcttggatatcaaaagtagcagtttccaggtcatcaaatttatttgcaaaaatttgagtttgattacgcatttacaatttctcctcttttaagtttctctagtaagtcgttagggttcttaatatgacagaagttaaatcctaagtcaacacattttccatcatattcttcactatcgcctacgtgcaacacttcgtgccctaacagagggatcggagaatacgtgagcgtgcgagcaaagaatcgcggatctggtttacaaagtaaagcttcatccgagaaatgggtgaactcaaaacaattccaactatcaaacttacaagcacgacgcaggatatcccctgatatgaagttggtattgctcttaatactcaaatcataacgccccgaaagatacagcaagtacatcggtagatccacagctacatgaggtggaaacttaaggaaccattgttcacactcgaaacgaagctttgcagacttcaaaggtgttatcccaagttcgtaaccaagtctttcccaggcatatgctgcacactcggctgttccctgaagtgcagcattgtccagttccttcttgatcttattgtaagctgctctcgcttctacttccgtaatatctccatattttgcgatagtccaggctcgcatgtctgcgtaattggagtttgctgtgatcagtgtgttccatacatcaaaagagatatgtttaatagtcatattaagcccaccatgcgtctaagttaagattactatccactaccacttgttctatgtggtagccttttatctgtatcccactgttcaagagcatatcatacgcttcattgaaacgcaacttatcttctgcggaatataagcgagcattataaaatcggtaatcaacttcttcagcattagaagaaatacggaagaagtttgtttctacttcgggatcatttgctgaagtcttaatgtgaacttctccgtaattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatattttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcagggacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactctatctcctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtaaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattactaatctgtgcaaaacctgcttcataatcccatttttcaaaaggatttgttaccaaccatacaggttgatgaaaagagttagtaagatagtctctttctaccaaacctgggtatttttcatttaaagctgttgcaaacttatagcacaaagattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcataaccaccttcaaacaaaacaccaatttcatcattggcatttaaacgcgctaaagccccttccatgaaaagaatagggttttcagatgctttggtatgtctgatacggtttacacgtaacatgtgagcatcgtaggctatctccatatgtttattaaggaggtcggtgaaagattctcctttacttctcgcttccgcagcgatcagaggtaagttgatagaaactactccaaggttgaatcgtccatcgtatttttctccttgttcggtggcatagtacgacaaaaaggaacgacaacccatactcgtaacagtgccatctgctgatcccgtaacttctttgttcaaaggaacagaaataaaatctggataaatacgatcagcacaacatgccaaagcttgttgcttaaggtcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcgtatacatcttgttcggtcatttctagggcttcttcccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtggtagctaccccaatagattttggtttttctatctgtgcagcaccgatcttaaaaccattttctaacatatcttgataattaacaagacaacagtttgtaagaggagagagcagataatccaagtcgtgaatatgtccaaaaccttctgtatgccattctgacaagttttttggcagtatctgtgtcattgccatatgtttgcttaaaattcccgccaagagatccctgtgtgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcgtttggagaggaattgtcttcccatgatcttaccgttctttacagcggtcccatcgtgtccattataatcccaagttccatcaatgttacgcaagaagctatcacgaacagtgtaggctttaccgttctctactttactttcttccacaatgattgccataacaagcttattttcaatttcggtagtaaccgattctttaataccctctgtaacttcacgatcatattggatataaactcgctcctcggtcacttgcacgtctaccacatttttaaatgtgtatgtctgctgtgtagtgtaaaggacacgaacaacactcttcttacctactggcggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtgttcggcagatattcaaatgcagtatcttccgctacaaactgttcttcctcttgctcctcaatacttggcacaggcgcagcttcatcgtatttcgcagcaaacatatttttaaattcttgggccgtgacttctacaaggccgcgatcaccagtagcagcagagtgtgggcgtggtaaatccccaacttcaatatgcattgcatctaaacctgcttgacgatcaaagaagataaccttgcggaattgtttatctttatattgtggcagttcatacatacttgggtcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatccactaaataaggaacatctaacatttcagcaaagcgtccataactctggatggcttcggcaatcacacctgtgttcatgaccttcctcctgtgcgaaacgcacgtttagtaatgtttgacataatgatcaaatcttgtaaagtcatatctgggaactgttgttctaaaactccctcgacagcacctataatatctgacaattcaacaagttgcattattttgcaatcctgctcaacagcatcaaaaagttcttctacttcctctttaatcttttctatgctgccataaggttgtttcttaatgtctgttatgtgataccccgccatttaacgatcctctctgatttgattaatcttacgagcaagggcagctataagcttatcttcttcggatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattggaagggaagtcatttgcaacaataacctgatcccactccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaggtgtaagggagaactgtctcatgcttaactttgtccaaatcgcctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctaccacatcagaatgaaaacttccagtgacagtatcataacctttgcctaccagcggatgcttcagaggtgaacgatcagaaaggatcgcattagcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaagtcttctttgctcaattcaaagagtttcacataggtgtcatgagtcataatggtttctgatttaggatcgatacgctcacgccaaagttgcttcgcatatttaacaacttcgttaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaagttctgaatcttgaattttttggcaatctcactaccagttccagctacgttaacatattgaccttctggacgagataatttgtgtcgaaggttttgtggaagacgctggtaacagattgaatgtagcgttcggcacataacgttaggcggcattttacgccgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctcgactaagattaccaacatccaaactacaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcttcttctccattaaggccagagaaagcaggagtaacgaaagttaccatataataatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacaatgttgcttgtttgtcttgtagtgttgtgataccaaacacatctacatcaataatatttttcaaaaattctcctcccaaatccaataattgtctacataagtaggatgccttttgtcccactcttttctagcccaagctacggctgctaccaatacatctccatgacaaggttgaggtgagcagaagcaaactaaatctttcccttctaactctaataaatcttcaagagtgatcttaccacaacgaatttgctcccacaaccactctttatacctttgtatggttgatcctcgtggttcatcatcttttaacttaaaaggatttgcaaacttagaggcttttagtcccatatgtggcattgctctaccaatataaacagcaccctctgggattgttttgcctaaatggtaaaagtttaataccttcatattaacctaaacacatacgtgcgatcagaccctggatgagtttatctgcttcttcgcgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagcgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttagcacaatgaacaacacctttctgttgtcttgtggttctttgactgtaatatataaatcttttgtgcaatagaaacctgtggctttgtaagcgtcaccccaattatccactccacgatctatacgatcaaacttacagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaaccgcgtgaatttacgtagtagatttcatcctcaccagagaacatccaatccttgtctatcagatagaaagctaaactcacaggcgacaactcatccttcacagaatcattgtacagcatgtgggctgcaactgccaaacttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttgcacatgtcaagtaactctttgtcagattagtcttaatgattggtgatgttgatgacaatcttagtttcaaccttagcccaacagtaatctgcttcattaaaacgactagtcacaatgtattctcctgcacgagaacctgttaagcacactgcacctgtatctgtagctaagtagtagtcccgttcttgttcacttacttctgaatcgtagtagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcggggttagggtagcatattttttgaaaaaagtcaacacttattttttggtaagtagataaatcaattgttcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgctttaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtaccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctccttcttgttggctgcttcaatcatagcgttaagagtctccataccgctttcaactgcttgagcaatctcttggaacacagacttcttaaagatgtataaagaccctgcctgtaagcgttgcacacaacataaaatcgcttggtgatccatcaggaagtcgccgtaggctgaatcaatcttacctgtaattgggttctctcgtgaacgaggatcgtattctaatgtgatatgcgttacaccaggtaaagtaacaaactgacaacggatgttgacacgtggtgcaattgacacgctaaacaggctgtttgacatttaaacctcctcgtagtaaggcaaagctttaatcaattgttctgaagtaccattctctatccacgtagccccgttgtcaagagaaacataccctttcttatcgataaatttacggagacagccagtgaacttgtttttgtagatcatttcttctttcctttctttaatttgttgtgacctttacccttataaagcttgtgattacgagcagacgggttattttggttctccagtcggctaacaggtgtattccaaaggtttcctgctacaaaagatgctgccacaagttcttccaggtatacaaaatccaaagcaggtatctttgtttccctcatctcgcgttctacattagacaacacgccttcttccttactatcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgagccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgttattgtagccttgcacggtaacaacgagaaatggttggcttcttttgaagaggatcgtcaacacaatatcattttagacgctcctataaaagttatgcatatccttggtgaaaacaaagtgctcacttcctcccgttcaaaggaacaaattacaaacgaattagtaaaactgcttgacaatgttcttaacatgttcgataatgcacctatcgacacaaaacgtgtcttaatgtgaaaggagaatataatggcttaccctgattacattgacgaacgtgctatgggtttcttccgtaacttcttggttggtcgttctcacggagacaacggttccagttataaaacaagctgggatagtcaatgtggcgctaaggctaccaaaactttgaaaatgccaggtcgtccgttgtgcgcgtattgtggtaatgaagccttagctcttcaacctggtattgaacatggtgattatactattaaaggctacacttgtgtctgcaaaggtgcaatggacgaggcggattgggtgaaagaaaaagcagagatggaggaacgtcataaacgagaagcttatgaaatggaaaaacgtatgcctgttccagatttgcaagttaagaaaaatattgttgcgaaaatgatggaaaaagtccagaaagcagagacggaagaagacctaaatcgtgcactggaaaacttacgtaattttaaagaagaaaaagagttgcgtgagattatgtggtaaggtatactatttccatcaattaagagaggagaaccaaatgtattattcacaagacgaagtagcaaacattaaactggcagtgggcgatcttattgtgtcacctaactactattgggataacacagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagctttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacggttagagggccgtcttttattcgctagttattttgataatctttggagctaaatatgtctgaattcttcacaatggctttcttagggatctatctgattattagtgctgttggcttaatcatgtctctaatagaggaaatgggaattaagtggaattgtgcattcggtatagctcttatgctcactccagtttggatttacatttgcaaatcggttgaactaattggttagtggaggtaatatgtttagtaaagaaatgagagaggtaatcgctactctggtagttgatcatggtattgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggataccatttgtcgtaaacataatattgaaccagaatacgggagtatgtaatgttaagcatcaaacctaaaatgattactgaagatcaaaaagagtacatttataaatgtggtcgggtgtggaaagaatacactaaaggtaatgaagttattgtagttacggaacatgctatttctttatcagatctttttggtgattatttgcaagtcattaaaattggtattgacagaggtttggtgcaggtgttaacattatcccaagttgaagcagaacacttagacaaaatcattgtcgagttctaagaggagaaagaatatgatctctttagaatcaatagcttttaagaaagggtataccgcagggttcaagtttggtatgtttaataaagtaaatccatactgtccaatgacacacaaaaaggaattcgaagaatgggaagatggattttctaaaggctaccaggcaaagggttggttgtaaggagagaatatgattttaaacttcatcatcaacttgtgtttgacattgggactactctgtgcaatagtatcccctctggttggtgaatattgttctgaactggcgatgtttatagttcttggtgcggctattgctaatatgtttgtcgctgcgatttgtatgttgtgggaataggagggaagtttatgaaaaaattaatcttagccacattgctggctaccgtaagcttcaccacttacgctcaaaaatttgtagcagttaaaacggatattggtaaagatgttgtgatcacaggcaacaaattttactatacacctgggaatggtgttctagaagagtgccaagatgttgaggcatatacaggaaaagaagataacacggaacgtcctttttattcgattatagccacttgcaaaaatgaaatagtagctattaaacaatacaaagatgcccctggaggagaatacttattagtcaagaacattaagagtgaaaaaactgcaaagtttacagtaattattttaaaaggagaaacgttctaatgaaatacactatttttggagatgtagctgttgtaaataaggaatatggtgttgaagctaataaacttcctgctggagtttgggttgtcaactgtgatccgcacggtaactactctttagtgcgtggcgaaagtttctctcttccgaacactctttatggggaaactaaagaccgcgccgcacatgttattaaaacatttgctcgtcgtagtaaagaaggtaaaaatactggggtgttactgacaggcacaaaaggcagtggtaagacgatgttagctaaactaattagcatgtccctaatgtccacagaaggtttaggtattccaaccattttggttacacagccttacacagatgctggattcttagaatttatgagtaaaattacagatcgtgctgttgttttatttgacgaatttgataaagtgtacgctaagaaagaagatcaggaagcactgttgaccttgttggatggaacaggaagtgggaataaactttacatcctcactaaaaatagtggctatatctcggaatattttgtaaaccgtcctagccgtatttattacagtttcaattacgataaactgtctagtgaaactatgttagattacttggataagaatttggtaaataaaaagcacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaacgatgctaaatggaatgtggcttctatcgtagctaatggcaaaacgctgaaggtgaattggatcaataactggcacgacttcacccctactaagtttttgtcgggtgcttgttccctaaacatctatctacaaagcttgaaagatgatgaagtggaagcaatggaaaccaacagttatgttatcctagatgaagatggtgatccacatattgatctatgtgcaacggcggatggtctaacttgtgatctgattgaaggtggtaagattcttgtgatgagcactacaccaggaaacactttgcgagtggtgctggagcctgtaacacaacgttccactacactgggtagcgtgttctgatacagcacaaatagctaaacccgcttcggcgggttttgttatattgatttcagacttatagggagagaggatagacaaagatggcgaagacgttagaacagtatataggagaatgtaaaccaatagcggaagctaaaggatatgagattatagggattgtagagccatttaaaggtgtgcacacgaagatgatcaacttctgccctaatcatggggagtggagaacatccacatttgccaattttaaacgtggtaagtctggttgccctgggtgcaaaaatgagaaggcaagacaagacaacagtaaaaacctagattattacctttcggaatgtaagcctattgctgaagctaagggaatcaagattttaggcattaatggagagtttataggtgtacatacaaagatgatcaacctttgtcctgagcacggggaatggcgaacattaacatttcataatcttaagggtggtagtggttgtcctaaatgcggtaacaaaagatctaggaattctaaaatactcccagacgatcagcacatacaagacttcattaatacaggaaagtttaaagagggtacaatcttcactaaaacagataaaaaacgaggccgcgattctttatggtgtgtagagtgtcctgcctgctctcacgatgagtatgtgcaagctggggtgtgtgatggtaagttttatgtcgcagggaatgaccttaaacaagggaagattccttgccgttgtgcaactaactgtcattacacagaagcacagattacctatagggtaaaaaaggcagtagaaaggaaagggtatatctgggtaggttggatcgggaaaccgtctgtaagattaggtaagtttaaatatggatgtaagaaacatggggtacaaataggacgtgccagtggtttgttaaatcatggtactggttgtccgcaatgtgctaaccagacacaacaacaatgttacattaaccacatccatgatgaacaaggtattctctgtgctttgaaatttggaattgccaataatagtgatcgccgtatcaaaaaacaaaatagtcataatgtgtttactatgaaacaggtccaagtgtggcacttccctactgtgaagcaatgcaaagatgcagagaagcgttgtaagcgtgtccttcacacggaagcagtgagcaaatatgctatgccagatggctacacagagacagtagagttatcttgcatggcctcaatacaaaacatttataaactttatggtggaacattacaggaggaaacatgttagttgacgttcaaattatgcgcaacgaaagaatggacttctttgaagcagtagagaaacatctgatcagatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgattatgtattcttcttttcacataaagatgtttttagtaattggtatattgcaccctttacagaaaccgaaccaggttacaatcagacatttaattgtgtcgaacaatacatgatgtggcgtaaagctttgctctttaacgatcacaacaccgcacaagctattctgactcatagcttaaaacgagaagatgagaagatacaagcttattacaaacgtatgggtagggcagtagcaggtttcgataacaaaatatgggaagagaatcgtgagcgtattgttatgcgaggtttatgcttgaagtatgtacagaatccagacttgtatgccgatttacgtctatatcaatacaaaacatttgttgaagcaagtccttacgataaggtatacggaattggaatggggatgtatgaaccaggggtgctaaaccctgccacctggaaagggcagaatcttttaggcaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctgttattttgtcctatacaaacccttatctttttcagtttgcatcactaggattcgatctaagtgggttcctgaaggtttaccaataagattaaaggttatctcaaattcccactacctattatctcaaaaatccctcaaattatttaaactttttaagaatttacaaaagtgaaagttgaaaaccaaaatttaaagtttaggaaaattatcttaaaatgttagatacaaaacaaaactcaaaagtcaaggaaaattttaaaaattttgcgcgcccacagtatttaaagtttttttgcttttacaaaaatgaaagtacaaaagcaaaatttaaagtttacaaaaatttatgcagatgggaatgagaagagttctcatatggaaatgcaaatgataatgattcgcatttaggtttataaatgagattgattcttatttgataaggtaaatgataatcattctcatttagagaatgacgcgcaggggcggtgtttgtctcgcgctcccgtgtcccctcgccatgtaataagaataacagatccagccaggaaagcaagcgattattttatctttacatttctttacaaatatatagcgcccagcctaccggcgatcaaccttccaaccagcgccctggtatgttagccccgcctttacgccgtggggtggcgcttcctcttctgtatgtaaaacagtataagcccgatccctgggcttgtcaagattattttttgttttcttgccaggaaaggacacctaaccaaaaatgcatatcgccccgcgcccctggtgggatcttgctttccccgccgccactgcaagcccataaataaccatcagcaaacggatcaaaatggtctatctcttccaccttatgatcgcccaggttgagaacggtttcaacctttaagcccgttgcgcttgctacctggtgcaccgtgccgccttgccagcccaatgagtgcataaggtgtaatgtagtatttgtcatggtgtcgccctttctttgttgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaagatcatggcaacattgcacattgtggcgaaagctggacaaatcaacgtaatagtaaacggttttactgagttcagtcatccccaggatgatcatgaaacggttttatctttcattgattcactgttagaaatgggagtaattacagaagatcagcatactgcaaaatgcaagcgcgttaagcagattgtaggaatagaataaaagtcttgacaacaagccacaacctgataagatgtatcacatagggcggcggaatggtccagccgctcacaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaaattcaataaacaagattatctcggtttcgctattgaaaaaaccgcgcgttttgttgattataaaagcccaaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggcgcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcacgtagtaacggcaacgtaaaagcgcgttatgtgcgccctggctggctggcaaatggtaacgctgatttatccagtgcggaagatgcgagcgacggcgcgaaagataatcctttgtacaaagttgatccggcttttcgtgtcctggatgaataccccagcaagatagcggcgcttgatgaagcattagaaagtaagcgcataacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttgtgtattgatgcttttcctgattatcagccgacagaggaagaaaaaaggatcgcactagaaaactttgaaaatagtctttgacatatcgccgccactggtataatatttaccacgtagggcggcaatggtgccgctcatagtgaaattatgcaagaggtttacaatgattaataaagaaaatagcttgacggttggaacgattaacgctatcattttcgccgttccattttgggttgtagtagcggctattattttctaaaaatattcttgacaacgttttttaatctgataagatgtatcacatagggcggcggaatacttccccgccaaaacaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgctacttacaacaaggcggtacctggtctgggaagtaccgaagagttgcacggcttaaacttggatcagaacacttgggatagtatgcgccgcgttatggtatgggccgaaagcggtaaaatttacgaataaaaacggttgacactgtttaaaattccggtatagtttaccacatagggcgggaagtggtttcccgccaacaatgaaaaaggttatcatcatggctattaatattaatgtttcctcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgttaaacgtaaaaaagatctataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgctaccgtttgaaacaggatggaatcactacaacgccagacggctttaagtatagtaaaactgcaatccgcgccgctatggttggaatgtaaaggagacataaaaatgaaacatcgttcgacctatctcacaaaacgttttagcttagatcataaattgggctattacggaagaaatagaaaataatttgacaacgtttaaaattagtgtaagatgtatcacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggagaatatgcgagcgtcgagtacatcgaatcctaccaggtgccaaccatcagcctaaccgatctcaacattgatcgcctgttatgcctggatgaattaatctgaaaaagattgttgacaccggaaagaaaaagagtaaactgtattacgtagggcggcaatggtgccgctcacaacagaagagagattatcacgatggctaatatccgcacactgttaaaaaatgcaagtcaagttttattttcagatgacgagtatttcaataaagacattacaggcgtgaaaaatttaaaagacgttaaggatgtaataggtattcgcggatctttacgtaagggcgattactacggtaacaaggtgcaatataaactgtcaaaagattatgattttactttgacaattatcaactaagggatcacaaaatgaaaacttgccaatgtggtaaaaagtctatctctggtttaaaacgtggcgttgctctttgtcaataccactataacgctcaaacgtggggtaagcagtgggcggatcaggtggaagaggcaaagaaagaaaatataaaagtagttgcaaagaaataaaaatagagtaaactgtattacatcaaggcggcggaatggtccaccgcctaacaaagagaagaggaaaatatcatgatcactttcgctacccgtgaagccgctcgcaacgttgcacgtaaagttaacgccgccaacttgggcgctacgcttaaagcccctgtaaaagatgaatcaggaaaatggatcttccctggtctgcgtcatgctgacaagttaggtactttaagccttaaaaaataatcgttgacttttcgttatagcgccttataatgggcgctatagagaagagaaaccactattaacaaggaaacatcatgattacttttgctattgtcgccgttgttgctggtcaggtttacgtaaacgagacatttactacagaagacaaggccgcaggagatataaccgccgtttacaatgagtgcaaggcagtagaaaggatgttatcgccttgtatgctaatgagtgaacgtcaggatgggataacagtatttactaacattgaaacagggtaccaaatggtagtaacaaaataaagcttgacacggatttaattttcagtaaactgttacacgtagggcgggaatagttcccgctaaaaagagagaaagaccatgaaagcacaaaatgcaattaaagagtacatccttgccgctatcgattttaatgattatggtattacaaccgaaaaagagaagatcgcggaattgatgcgccgttttaattccgagtactggtaccctgataaccaatcacgttttaattatagtattgttaaagcacttgcatcatggttacaaggtttgccatcagatattaatatcgctttcgaatattgggaaattgatcgcttgttaacatcctggggatacattaaagagaatagcagcgatgataaaatccaacgagaaagggaaaattattggctttatattgcaggcgtgatccttgcttgctcttatgaatgataaaccttgacaattttacaaaacagtttaaattaataatatagcggcaatggtgccgctcatataaagaggaaacaaaatgaatacatctaatcgcgcagaaaaaattcaatcttccaagatccgcaaggcctggaatgaggaagtgatccgcaaaggcgacaagcgcaataaaacaaagcgcgggaagagtgacaaatataattggatggatttagagaattaacataacaa

SEQ ID NO: 26 - DNA, 72689 bp, Unknown
  Podoviridae; G7cvirus
tggctggggctacacccttacactcaactagcccccccggtatgttgacggtgtagccactaccctaccccaccttacacgttacacatgctccgcatgttatggacatgtcgtcctatcatcaactattggagctatcatcatgactactaccgctactgtacgtatgaccgcaggaactttacttggtactgttaactcagctgctactactgttgcagatacatttggtacagcaactaaagcagtaggtatgcttaattcatatgtaagtactatggcagagaaacaagccatccgtactaaattagaaatgcatacctttgttaataaactggcagaggagacagctatgactgagactctgcgtaagaaaagtattgaagaattctgcaaggataaagagaacgctcggatctataacgcagaatattcaaaagtaatcgacatcctgactaaaagctaagtcacataggaggctcttcggagtctcctgttttgaacattagatagatagtcaaaagtagataaatatctactttaggagaaataaaatgtccctgacagattgcaaatctgaatctccgcaggaagcattagaacgttttgaagaagccgttcgtcagcaagagcaatatcagtctgacatccatcattatggagaatcagacatagatatctcagacgaaactgtagaaagtaagtatcagaaagctaaggctgaattactaacctggttgtcctacattccgtaaaaaccaagacgctccgcgtcttatggatgatgtaaatgcatccactaatcattgaacttttatccttttgtttgggtgttctcaccgacgagttcacccgtaaatcacataaatctggagagtacaaaatgtctattcaaaaattcactttcggtcaatctaacaatgctgctacttctactactaaaactgataagcctaaagctcagttctggctgaacattggctatgtagctaacgaaggttctgatgatgagaaattcatctcattgcctactggtattccgctggatactcaggaaccgctgcctactaatagcagcaatgctgacttccgtgctatgcgttgtgcacagaacgacttgctggaacagttaatcgaatatgctcagaacctggaaccaggtgaagaaggtatcattaacctgcaagttcaacttcgtcgtgtgaaagcagaggctgctgacatcccagcagacgagaataaatatgctcgtaaactgactttctaatcaaccactagactcccttcggggagtcttttatttttaactagacgataatctatttctactttttgagtatctttagacgaagggtactgaaacagtaaccagatagatatagatttatattagatgaaggagtaaccattatgcgtacagtatgtaaccgttataactcacaaaagttgattgttatgttacaaccttggggtagtaagatgtctcttaatgctcgttggcaggtatctgtagaagataagaatggtcagcattatgaccacttctttgtagctaaacctactcgtaaacaaatccgtaaacttcataaggtgtaagactatgttggacttcattgcgtttgtaatactctgttatgtgctgtatcgcctacgtggttacattctcaatggagccaagtgggtaagaactaagctggtacttatctgtaagttacctgttgtattcgttaagtgtctgtttgcttccatcgtagctaaagaggtacgcaagcaactatgggctaaagaagcagaagagtttgcaaagaggaaccagtgatattcactaacatagaagatgccattgaagagtgtatctttcgtagatatcacactggtgtacagaaacgacactatggtgttgtgcaactcaatggctatcaaatggttgtaagaattgtacgtaacagcaaaccttttaactttatgtggagtactaaacatgcgtaagtcattaatcatgggaaccaaagctgacgtacagagaatgaaggaacgtctggctgctaagcaacagacatctgaaccagtacgtaagattgttactttcaatcataggtgtatcaaataataaggagtcctccaataggaggctcctattttttatttttgaatagttagatatgtatttaaataggagaaataaccttgaatgaaatagtatgtatacttcctcaccaagctaaagtagctgacaggaatatacgggtacatttaccattcccattaagtaatccatttgctcgtaacgaaagaaccacggtagaagatatagaggtagcttatgaggcttaccttcgtaatcgtcttattaatggtgacaagttaattacagcagagatggaaaggattgctggctttgtaactgatagtacaggtaaacctgttggtttaattggtactgaatctgatgttaacgttattcgtaaaatactgatggaggcactcggtgaacaatcttagtgatgtcatcgtagataaaacaatattagtaaatcccaaagggtatgcctggttcatgctaaagcatacccgtaaggtatatgttagaaaggtatatatacgtaactttggtaagttatcttacagagaagtacgtattaataatgagatgtactttctagatgaatcagtgattatcaaatcaactgaagacagaaaggctccttactttaactattacggattcaactaaaatgatgtactcaactgattatggtgtttgccctgtatgtaacaaacgtaaaggagttgctaatcataagcgttgtagtcgtatattacagaaacaacggaaccagaaagaatgggataagctgttggaaaaccagcataaagaagaaaatcaacagatggctgttaaggcatctactcaacgtattcgtcgtattaactatatacaggggtatcagaaatgagactaatcgtagctggtggaagagacttcgtaaataccaatcttatgattgaggaattacagaagttagtaaattcagtaaatatacctgaatgcccagaattagtatgtggtatggctcgtggagcagatatgcttgcatataatctatgggctaataacaaaatgcctattcataatttcccagcaaactgggataaatatggaaagtctgctggttatagacgtaaccaggaaatgggtgaatttgcagatgctgctgtatgtttctgggatggtaattccaaaggaaccaagcacatgattgatatcatgtataggcttaataaacccgtatacgttgtgaggtactaaatgattattacatatcctacaggcaagactgtggaatatatgaagcacaccattcaagtacctcactgggttaagtatatagctttattaccacgtcaatataaaagtgctaatacctcattaataggattctctaagaagcctaagctaacagaaaacaatatctgggtatcctctgggagacaagaagaaattggtttttgtgatttgagtattgtcgataataacatctatgggacattgagaaaggtatgaaaactattctagtagttcatgattctacatttacagatgtagataaaatgatgcgtaatattgattatgtatctcaaacaagccaggcattcaatgaagaatttaccctctactgcaatgctgaatctccactggttcctatccttaaagaatcaggtctaccattctctacagagaacttcccggaagaaccagactatgtaatctcattcatttatgacttacatgatggttctgaaactagtgaactagctatgaaccagtggcgtagtaaacgtcctgtgttcgcattccaggtacttaagccatgatttataaagaatattatgtattcaaaaagggggatgattttatagctatgccggatgattatatagattggcatacaactcccgtattaaatgaagcattttctgtacctaacctagaagaggttaataaagtaatgaacggggtaatgttaacaagagggttagcttacaaaatagacgcattagaaggaactactgtatgtaaagtaagtacatctattgaggcattaaaaccatgaagactattacattaggggacgacaccaatgctttgctgggtgtagctgcacgtccaattatcattgttaataaacatcacggtaaatccggtgagtatatcggacgtggttcaccattaggaaatccattcgttattggtaaagacggttcaagagaacaggttatagccaaatatcgagtatggcttaatgaacaaatcatgaggaagaatcaagctgtattggatgaacttaatcgtcttggtaataaagccattgatgagaaagggttggccttacagtgcttctgttatccgaaaccatgtcatggtgaggttattaaagagaagctagtaaaagctatgtataactactttgtggagaatccaaaggggtaactaatgaaagaaatattcgtattcactaccaatacactaggacaacataccaatgcttctgccaagttagcttataagaaacatggtgctcgttggggcatggcctatggtcactatggtaatagctttgctattccagtaagagatggcaatggtaaccgtatcaaagagggtgctatctatggcttcattgagggctttattgcttatgcatctgccaatccacaatgggatttcaaagtcatgagtaatgactacctggacccataccagttcattaatgtaaccggaaatgtactgttacccgaagcatggcgtaaacacttaggcgatgcttacaactactggagttaataatgacttatgaagaactgtgggctgctcaagtcagagccagagcacttacacggcatgatatctattgtgcattacaaaacgaactaaaggatcgtactaaactaggtcacatatctggtttaattaaaatacctatgcgtagtctggtatggccttaccagaagaaaaataacgagtttagtggtaatggtttatatgtacgtattgactaccttggtcaagagaacagtattcgtattaccttttggactaaacgttaggtaatagctgctccgcagcttttggttattaatcacatttaggagaataagcgatgtactcatccattgaacatcagaagcaactcgaaattcttttcaacaaaaatcaattactccctcgcatgaggaaggaatttgaggactccgaagaaattgactttaaggcattcgctgcctatttggaaattgattataagctgctcattgatgcaatggtgcagattgccctacataaacgtgctgaccttcagactatgattggctctcttatgagccattcagatgatgctcagtacatcgctgactgtctgtataagatggcagagaatgactgcttcaactatgaccctaccatcgacaagttcggtgttatctacgagattagtgaagatgttcagatggaactggaagcattccagtatccattacctatcgtaagtgctcctaagcctgttctgtgtaaccgtgatacaggttactatgagagcaggggaagtattatcctcaagaagaaccatcatgagatggatgtctgtcttgatcacatcaaccgtatgaataatcaacgtctaagcattaactgggacgttgctaactatgtaaaagactctcgtcctaatatggataaacccaaagagggtgaaacccgtcaggaatatgagaaacgtgttaaagcctttgagaagtacagccgtactgctaaggaagtaatggagttagtgaccaaagaaggtaataacttctcactgggtcacaaatatgacaaacgtgggcgtacttacgctcagggctatcacatcaactatcagggaaccagttacaacaaagctgtactggaatttgctgataaggagttagtaaataatgattaatcatcgtgcagtaaaagacttctatgcccatagggaattggtactaaaacgtatcaatgaagcaatgaaacgtgaagctgaagctaaacgtaaccgtaaataaattcaaatgcgagccaagaggactaatcccaatgagtgagttattaaaactatggcttattagccagaatgagcgtaaggggtgggatacgttcgactctgctgtggtagcagctaaaaccgcagaagaggctcgtcttattaacccagatggagaatggagtacatactccgcttggtgttcttccccagataaagtgcacgtcgagtacctgggtattgccaccgaaggtgtggaaccaggaatagtattgtcatcatttaatgctggctaatacatccaataagcaggctctccatagtggggagccaagaagcaaaaggaacataaaatgcaactgttaaccgctcgtgaatacctgaaagtagatattgccaataactatggtctggataaaaagacctgggatgagcgtattgcttggttcgatgagaatgaagctaacttgcttaatctggtagatgaagctgaggaatctgcactgttctatgctggtgtaaacgcatggaaagatatgaaagctggtaagcctatcggatatgccgtagccctggatgctacatcatcaggcttgcagttactggcctgcctgactggtgaccgctctgctgctgaactgtgtaacgtagttaattacatgggagagaatggtaagccattacgacgtgatgcttatacagttatatatcacaagatgctggacatccttggtgaagcatcccgtattaaacgtagtgataccaagcaggcagttatgactgcattctacggttcagaagccaaacctaaagaagtattcggggaaggtatccgtctcaagacttttgaaaatgtaatggaaacagttgcaagtggtccttgggcacttaacaagttcttactgcaatgtggtaacccggatgctaaccgttacatatgggtactccctgacaacttccacgctgtcattaaagtcatggttcttgaagtacagactgttaacttcttgggtaaaccatttgacatcactcgtatggttcagggtactgaagagaagacccgtatgctctctgctaacatcactcactctattgatgggatggtagtacgtgagatgctgcgtcgttgtaacttcgaccctaaactggttgcctatgtacgggaactgtgcgatatcgggccaagtgaataccccgttattgaggggaaccaagagaagactatggaaatctggaatcattatgaaaggtcaggattcctgtcgctgtctatcctagacttccttgacccgaatactattgcactggtagaccgtcaagtagtagcagatatgatcgacactatgcctaagaaaccattccctgtaatgactgtacatgattgcttccgttgccaccctaactatggtaatgacctgcgtcgtcagtacaatcagattctgtctgacattgctaagagtgacttactgggcttcattctgtctcaagtactgggacaagagttctctgctggtaagctggatgacagcctctggcaagacattctagaaacagattatgcattaagttaataaactagcctcattccttcgggagtggggctttattttttgcttggaggtagcaactatgcttatcaattttgaagtaatctctcagctaatactgatagttttatctgtactggttctggctacgatagttcgtgcccacaagtctaagtttgcttactgctactatggagcatactcactaggatgctttgtaatggcaggatggatagcttttgctatctactgtgtaaacaactaaccctcttaacggagggtttatttttttacatgtcatgtatactaatcctgctatttacttatgaggaaattcatatgccaactttaaaagtaggttttaacaaaaccaccaatgtcgcaactgtactggatgcgagtggttctatcccgggtggttcagtagaagtaggtacttttgtacacccggatgccacttacccagatagtttagttatttttcatggtgttcgtgatctgctgtataaacgttctgctaaagacccatctgaagaaggcttctggcctaacaacatcgtagatatgcagtccatctctattgatatgcaagctactccacgactgactattgctactaagctgcctcgtgtagtctccgctatcgaaggcgaagatattaactggcatgttgatgtagcaggcggtaaagcaccatttacttataaatggcagttcaaagctgatactgctggtgcagcattcactgatattagctctagtactaacccatctgctgctactgcaacattaacccttaatgacgtaaccgctgcttctgctggtacttataaagtgattgttactgatgccaatggaaccactgtagaagataagtctctactggctgttggctactacgaagcaagctcactggtagctactcctgcttcattgtctctgtctgttgctgctgatgctacttctggtaagactgtaaccattactaatgtgcctattggttcatctgctggtactttgtctattaagactgccccagagtctggtcgtgctacggctaccattgctggtaacgtattgacggttaaacctgtagctgctggtgaagctacttctgtagtagttaccaacggtaaggtcgatgtaaccatcgctattactgttgtagaataaaggtagcctttatttggggttgtaaaccctgatataaaactcccaagcttgacctcccagatgaagggaggtctttttttgacttaaacattctggagccaggaaatgtataaagagattgcatttttctcattcttactaggcggtttattaggtgcaggatttgtagctatttctaatacctactttggttctactccaaattctgtaacacaaaccctcaagcatgaatgtgaattgaatatccctcgtaatcaaaactgtgtaatgcagttcgtaccggagaaaaaatgaatatccacaatctacgtttggttgagaaactgtacgaagaatacaacgacaaccgacagcaattagctagtttgaagaagtcaccacatatggtgaaagtatcattcaatggtacggatttaggaccgcaagctcgtacaagaatacttcctgaactgctgtcattttatcaaaagagaattgctgtcttagaaaaacgctttgagcatttatgtgtagatttatcaccactcccagatgaaggagaagatgagtgaaattaacccagtcccaagcaatcttccttcgtatggttcaaggtggttctgccaccagcaaccgcaataataaaaccgcacagtctcttaagaaactgggcttagtgcagttcaatgctggtcttgggtggtcattaacccctactggagtacttcaactcaacgagttaaaaggtaactaaatgaaaactttaattgctgttgctgtagtagctttatcagttctgtcattcaatgctcaagcatccagccgtgaaactctgttagacgctgctgccgactacaaagccaataatgcaaactttgtgaaccagggttacttcatgggcatggttactatgggtgtagaggcaggaaataattgtgtaccggagaatatgaagttaggagccatatttgacagagtagcttctattatcctgtacgaccgaaaggttaatgcagtaaaagtgccatcagacatggttctgttagcaattgatacagcatacccatgtattaaatcttaattagtaattccattaactttaggagagtaagtaaatggcgagcattgactcactgaccgtatgtaatacacgtcaggcccgtaactttattatccgtgccctgcaagcaggtaacgtaccgttcctgacttcatcaccgggaatgggtaaatctgcaattattcgctctgttgcagaagaatttggtatgaaactgatagaccatcgtctgtctacttctgccccagaggatttgtctggtctaccattccgtaatggtgaccgtgcagagtttatcccattcgctgacttattccctattgagggggatgagataccggaaggatataatggttggctcctgttccttgatgagttcaactcagccagaaaagaagtagtagctgctgcatacaaactgattctagaccgtatgactggtcagaaaaaactccatcctaatgtgatgattatatgtgctggtaacaaagctactgaccgtgccattgttaacccactgggtactgcaatgcagtctcgcgtggttcactttgaaatggaacttaacttcgacatctttgttgaagacgtaatgattccacaagaatgggatgaacgtctggttgcattcttacatgctaacccaggttatctgcatgacttcgacccagcccataagaacaaaacgttctgttgcccacgcacctgggactttgttaacaaagacctcaagaaccgtcctgaaggtgctctgccagatgaagattctatctactatgcaggacacgttactgctggtaaggctacagaatttgttcagtttactcaggtatacaatcgtgtgattacgattgagaaagtagtcaaagacccgttaggctgtgcactaccagaagataacaacctgtgttgggctaccgttaatcatctggctaacaaaactactgaagagaacttcgatgatgttattcagtacattgaacgctttaaaacattcacccataagattctgtacttccgtacagtaggtagagcattaccagaacttcaggctacccctgaatggcgtaaggctgctgctaacatctctcgttacattcacggataatcacagcatgaaccggatacctcagcacacactcagtgatgaacaactcatgcgtgagtatgaccgtactcaggccaacgctttcctaggaagcagtgcagcgttctttggttcattactgtgtagtcttaaattctcatggaaacgtgaggattgtcccactgcatgtactgatgggatagagcttcgtttcaatccagacttctttatctggatgtgtccagatgcaagaaaaaccgtactaatgcacgagctatggcatgtggcatatttacatggcatccgacgtggaagccgtgacccagaaatctggaatcaggcatgtgaccacttcattaaccttcagttagaggaagacggttacaagttcactggtatcgacgaaggtatttgcaaagaccctcagtataaaggatgggtcgaagaagacatttatgatgacctgatgaagaaccctcagaaaaggcagaagccgtcagggggtgttggagcaggtcttgctggcgacatgaaatccccctcttcggggcagtcccagggtgctgttgtcaacaacgtagtacgtgcaatgcaaagtcagaagatggctggtggaacaatgcctggtaagggtgctggtcgtatggaagaggttattacccaattccttaagccagtggttccatggcaagaagttctgatgaacttctttaccgacattgatgatactcattatacgtgggccagacctaaccgtcgttacactgacatctatctaccttcactggaagatgatgaaggacgtttacgacacttggcctactttgaggatgtatctggttctattagtagtgctgactctctgcgatttaactcagaagttgcctacgttaagagccagttcaatcctaagaagatgtccttaattaccttcgacgatattatccaagaagaaatagacatcactgaagaagatacttttgaagagattaagattactggtcgtggtggtacaagccttgtgccagtacgcgagtggattattaagaataagccaaccgctgcaatcatattctccgatatgtatgttcgtccaatggaagaattaccatttgatattcctatcatctggtgtgttctgaataatcccaatgctaccgtaccttttggggaggtagttcatatccctaaaggaatgaaataatggttgttaatggtaattctctataccgttcatctcagttgctggatatcccagaccgtaaggtatcagagcatggtgtaagctatggattaggtgaagctggttatgatattcgtatcaaacaagatattaccttctatcgcttatttgggctgattccaatggtgaaagtcgttgatggaaatcaagtatcacgccatctcggtaagttcgccttggcctcagcaattgagaagttcaacatgtccccgtcctgtgtagcaatcgttcacgataagtctacatgggcaagacgtgcattatcagtgttcaataccgtaatagaaccaggatggaaagggtatcttaccctcgaactggtctatcacggtcgtaagaaattgcatatcccggctggtgctgggatagctcaagtattatttcatctggttcaggaacctgctaattacaatggcaagtatcagaaccaggaaaacaaaccagtagctgctagaccttcaaaataaaaggctatccggcttaattaaggaaaactcatgtctgtatttcaagtaacacaagaaaatactggtattcgcctgacccttaatgcgaaccaagtaattgcagtgcaagaacttaccgcaggtaactctgctattactaccgtaggtggtgatgtagtaattaccaaagaaacctatcgttcagtacgtaattacctgaagaaagctcttgctcctgcaagcaaagatgctgagtaagtagctgcttaaatagcccagcatagttgggctatttgtgaagaaactaactcaaccccacataggaaccatcatggaatctttagcagcaatccttgttctgttatttgtattagctgtataccttatccctactatcattgcttttgcacgaggccatgcctccaagtggggcattggtgtactcaatattgtattaggctggtctttagtcttctgggtagtagcactgatttggtcactgtccaacaaaggtcagaaccaagttacaaacgtaactgttgttcaaaccaatggtggcagtaaatcagagtaactaacctaagcatcattacatagtgatgcttgtggaagttacttccagctcattgcttatccatctcctaacccaagcccacctaacccgtgggcttttttatttacaggtactcttatgtcaagcagacaaaatggtaagtctatcctgcaagggctggacttaagtaagctggaacaaactgcaatgcttactctaggtaaaactatccatgatcaagtagagaatgaaattgagttagatctttacacgacaatgcaggctcttgttcaaaaaggatggactattagcagaccttttccttcatacattcctccggaacctcatctgaaatctaaggtagaccgaatcatagataagttctggcttagcccatgtagggatgatacgtatctttacctggctcaaatacaaaagaatcctcgtactaaggatgtgttcaaaggcaagagcactacccatcattacccttggtatagaagaggtagtaaatactaatgcgtatcccattcctacggaaaagggaacgaaatcctgttctttacaataaaggcatagaggatgagtatgaactcaaccgtaaagctcgttcctacacaacaaaattattcatggggactaacaatcctgatagattactggactttgtttttgaacaaatctttatcatatacagcttagctatgtctgctggttcacaagaagtaagtgataaggcaagagatgctctctgtatgctccgcagggagtatgaagccctcatgtatgaagacttatactcctttaaaaaagaaaccgctgtagcgtgttctgtggcccttactgaaggtgtagcagtattacaagaactaccccgtagtgagtttaagctggtatatgttcaggttaagaaaattacagaaaaccgtagtggtatcaccaactatctaaggtcattctaatgattaaggcaactgtcattgcagattccgttcacccagaaacaggaactcgtattactacctttgaattggtttatccccgattcattcacagtgagtttatgacccaccgtgtattcaaccgtaatgcctcaagcagtcgtgctattcccacggctaagttcatcgaacaagttcgtaatgaaccagtgatgcctagtcactggggcaagaaccagaaaggtatgcaagcagaagaagaactcactcctatggagattgaggatgctaagtttatctgggataacgctgcatctgctgctgctgtgtatgcagaacagctacgacgtgggcaagtacataagcagattgttaaccgtattctggaaccattcacgcatattcgtgtagtggtaacttcaaccagctgggctaatttctatggactgcgtgaccacaaagatgcgcaaccagagattcgtgaactggctcaagcaatgcgtaaggcacaggaagaaagtacaccgagagcattaccatatgggcaatggcatctgccatatattgctcatattgaccgtgttggggcttacaatttctgcaaacgcaatcgagttacacgcgatgaaccaagtgatgcagaagtgcatggactacttctcaaagtaagtgctgcacgctgtgctcgtgcttcctataacaacttcgaaggacgaccatctactatcgaggaagaccttggcttattcgctaagttagtagaaaaccagcctattcatgcttcacctactgaacatcaagctacacctatgaaccttggtgaaaagtatgtgaataacatgaacccagttacatgggaacaaggtgttacatccatggataaagaaggaaatctgtactcaggtaacctgcttcactttatccaattccgtaagttaattcctggtgagactattactgaatgaaaaaactagctttgtacgcaatgctaattagtaccctattaacacttaactacgcatacaaagttgcctttgtcgtagaaacagatatgcagttcattcgagctagtattctgttctttgtgagtgagtttggattatggtgtgtttactactttgctcatgactatgaagctattcgtgagcaagaggaagtaaagaaacgcatgagacgtttcattgaaggaaaatagtaagtaaacctaagacctcctcctggaggtctttttttgattctattaactcttttaggagggcgtatgcctgctaaataccgtatcaaagacacaccagtaatgtgtgagggtgagaagggtgacattgtatatgcctgtatacaggatgacttcaatgctgctctgatgttaactcaaatgacaaatacactgcatgtatcagtaacactggaccctaccggtgactatccatgctttcccatccctgctcataacctggagcaaattcatgattaatcctgaagttattcatagcaaaactggaaaagctgttccactcagtgagattgcagttacaggtgatattgctgcttgcccagctaacatcgcttccttatgtatgtgcattgctgcactggcagaagaacgtaagttatggctggaaccaagcaaggaaatgatactggctggtatgtctgaactaaatgcacttctgaaagaaatgtatgacgaggatgggcaactagttgaaccaactgatgaccaaatctcggatgctgttgtattcacccttcaagcaatggcaagtaaacgttaattaaatttaagaagcaacacttaaactggagagtaaataaatgttagttgcagataccaatgaagtagctacctcagcgacactgggtggcaaagaaactattgcctttggcatttccgatgacccggcattcttccatgtattaagtacttccttgtataacaatcctactctggcagtagtccgtgagactatctgtaatagttgggatgctcatattgaagcaggtaagactgatactcctattcgtatcactattgatacagacaattttattacattccgtgactttggtaatggtatccctgatgaactcattggttccatttatggtgtctatggtgcatctactaagaaatccaacagtagtgttactggtggttttggtttgggatgtaagtccccattcgcttatacagatagcttccaggttacttcatggaaccgtgggaagatgtcagtatataacgtagctaaggctgcgattgagaatgacggtaagcctggcattgttcctattgttactggtattcccactgaggaatcaggtctggaagttaaattccagttaggtaagcatgacgtaaatacctttgtgcattacattatatctattgtatttaacggtgagattaaagctgaacttagtatccctaaacttgttaaaacagaagaaggtaatagtattcagcaaggtgactacactctactgaatacattaggtatgtcatttgaacctggttcatatgatatgtctgatagctggtataagggttatatgggtaacagtaacatattcgttcgttacggtaacgtaatgtacccaattgtatccagcccagctagtgaagaggctgtgggtcttatcctcaactttatgaacattattggtgctgctaatttagtagttcaggctgcaccggatactctagctattgctcctagccgagaaacactgtctaaccaaaagttaaccgacgatggtattactactctatgcgtagatttagtagaccgtatggagaaggagattaaggctaaaattcctgaagctattaagcagattgaagaatacgcctctaaatcatctacccgttattgggaatattcatctttcttacttgcagttacagacagaactgttcaacgctatatgtcctctagcttgtgggctaaacaacgtaaacatcacatcaaacattggcgtaacttatccaataaagcattattagctcgccctgaatatgcgggtcttaagaagctgtatagtaaggctatgagtgctcttaaagatactcgtgcggatggtacaagctacccattccaggaattagtataccggcatctacatttacctcagcttgctgctttaaaagaaactggtattaagtggtctggttacatagtgaaccaaggtaaccgtgttgatctggtgagaggtaaacttactgattactttaagatgggctataactgccatttgggtattggtattttcactaccaagaacgttgtagttactcgacgtttatctgattgtgcggactctttctcatacttccctgaatacaaccgtggagacttagagcgtacagcttttgttcacgtcgttggtcctaagaaaggtgcagcagaagaagctgtagctaagttcactgctatgggttatcgggtaattgacctcactcaatataatgagtgggacaaaccaactaactaccgcagagaacaagctaagatagctgctgagaaacgagctaagacgatagctgccaataaaaccaaagcagggggtaaaactaatgctctgatttcgttgaatgcagttctcggtactactcctgtacgaaataaaagtggggattgggattctaagccgtacattgacaaggattttactgacccaagcttccatgagaagtacggtttcactgaagtggaacaacctaagtactacgtgttagccaatcaggttagttctggtagtccagtaactgcccggattggaaccatgtggaaatggtatgagttatccgatgagatgaaagcagagactgttgtctgccgtaatcaaatcgaagctaacaaggctaaacgacgtggtgctatccacattgacgatgttcgttttaaggaactgatgcctgtcattaccagcaagggatttaagaagtatgtcactgaacaccgtattggtattctggaatacgtaggactggatgacagagagtattgggaaatcctagatattcttggtctaacgttcaaaccattacagaatctgatttttaaaccagagtatgaatgggcttatgatttcttaagaaatcgaccacataacaacaaagaaaaacttgttgaaatgggttgtattaagtcagttgatgacttagagccatatacaatgatggttaatccgcgtaatcataagtactttgaaatacttaatcagtacaaggggttattcagctatagctggagtgctggtgacatactacagagtctggacttggggagtttagttaaacacctcaagaaaaatccagaggatattcctgggtttaagtccctctaccgtaatcgtctaaataaactgaaaggtaactaatctgatgaaaatcgaactgatttctatcatcgcactggcagttgacagtcgaaacttaacattgtggaagcctgatggctccacaattgtatatccacagagcgacccacgggttgctcgtatcgtatctgaagcacaaaccaaaggcttgggaattaccaaagacctgatagaagtaaacattgcaccagaagtatcactgcgtaatgagtatctggaagcagagaagaacactaatggattcgtccgtttcttcaaggtagctaaagctaaactcaaagagttcttccaggatggtacagatgttcaacctacccaagccgtttctgatattaagctaggcaatcccaccaagacattagtatctaaagctatggatacattcctggctgtacaagctaatgaaccagaagtaacagtatcagatggttgctacgacagacgtgacaatctgatgtggattactggctgggataaggaccataactatcctgcactggttcgttttattaacgacgtaatgggttgggggtatgaacaaaccaacaccatgctcagacaggaatggcctgttgcagttcgtgcagtatccgatgatgaaatgggtgagtttgctaaacaagccaagcacatcaaaggtgtacatattgtatttaccagccgtaaacataccccaccaccttacattgaagtagctaaaactacgaaccaggataagctggctgctgcatccgagaaattagctgcattaggtgctattagtactgataacgctaactttcacactgatgtgaaggaagatgaagtggttgttgctgttaccaacgatggggttatccctggagttgagaacctgcaacgtcacttacgtcagtctgccaagttgaaagactacaagggcttcactaagttccttgagcgtctggctccggttattaaagaccgtctgcactcagtagaagacctgatgaagttcatggaaactgctgaattgcctatcgctgatgatggttcaatcctgttccttaaacgccttcagtataaagggaaagaagatggtaaacgtgtattcgttgactgtcactcaggtaacatcaaacagtgggtaggctgtaaagtgcaggtacgggaagacctggtagatcctgaccgtcgtcaggactgttctaacggtctgcatgtagcatccatgagctacattcgtagcttcggtggtaacgtaactgtccttggtaaagtagcaccagaagatgtgtttgctgttcctcagtacagcactaataagatgcgtgtatctgcgtatcacattattgctgaactacccgaagaggaacgttgcaatgttaacagtggtatctatttgtctaaaactgaagtaggtaagaaactacttaatgatgccatcgttgggaaccatagttcacctaccacacttattatggttggtgggcatcgtggtactaacctcaaatacactaatctcacatctggttctgtagagcaattccgtacagttgctagtaaagaggcactgaatatggaagagtcactgaatgaagctgtagcttctgaaccagtgaaagctactgaccttaaacccgttattaagaaggctcctactgtgaaagaacaaatccaggaactggttaaagagttccttaatgcaacaacaccagaagataagttagctgctgctgaccttctggtagaactgcgttccaaagctcgtaagccttgggctgcatttgatgtaggtagtgacgtggtagctaagattgctgatgtacgtgctacctatacaactaagcctattggtaaacctaaagctgttaagcaggatatgacagttaaacctacccgttctgctgctgccactaaagtagctccttctggtaaacacgttgataatctgcgtagcatcctgaacgatacgtcatattctgactatcagaaaggccatgctctgcaagactataaacgtcatgctaagaagtcattcactgcaatgggtctgactgaagaagaagctaaattagctaccaagctggttaaagcagttaagtaatagcctgttcaaatgccctcacttgtaataaagtgagggtaattttgaggaggaattgtactatgagtaaagtattcagaagtaatcgcaaagcaactgatgaagacatcattcgtatgaatgctgttgggctgtccctcgcaactatcgctaagacgttgggggttcaccccactacggttactttgcgattgcgttctttaaacattgaaccagccgacacacgtcggacgttcatggaaaacgtattacgtcctttaccaacccatgtggctgattggctatcagaacaagttggtcctgcttatgaaattcgttcatatgtaagggacttgattctggaggcatataataatcgccaccttaaccaagagagtgagcatgacaagttcatccgtttgtacgctggcaaatacggaagcctggttccggaaagcagtaccaaatccgacgagtaagaatattagtacccagattggttgtcatctggaagaagtagtagagatgctagacgagttatacgctaactcagaagatgcttacgatattcttcacaatgccattgcagcattaaccgaattgtctgatttaatgaaaaaagatgacaaagaggtatatgcaccgaacagccatcgtttagctatccttgatagtcttgctgaccagattgttacagcaaccggcgtcggtactttccttgggatgaatgtccctggagcattggctgaggttaatcgctctaactattctaagtttgaagatggggaacctgtcttcaatgagaacaagaaagtcatgaaggggaaagactacactcccccagatttgtccagtttcatttaacgaaagccccaaatggggctttctttctatggagtcatatatgaattggcacgctttatttgaatacatagatggaaagctctattggaaagttaatccatctatggcagtgcgtataggacacgaagcagggtccataaatggagatggttacattcaagtaggttacaaaggccatgtttatcaagcacacatagttgtgtgggaaatgcacaacggcccggttccaccaggaatggtcatagaccatgacgacaggaacagaaccaataatcgaatagataatttgaacttagttactcaattacaaaacaatagaaacaagaccaaaagtaaaagaaacacatctggtgttactggagtgtactggcacaagcgtgaccagagatgggtagcatcaatcaggatagaaggtaagctgaaacagttgggtcagactacctgtctggaggaagctattaaattaagaagggaagctgaaataaaacatggcttccataaaaaccacggtaaataactggagatttaaatgttttccaaacctaccaaagccccactgaaccaggggcaagaagcggttgcgaaggagttcttcgacttcctgctcgaccctaatgctaccgaattcaatattagtggcccagggggaactggtaagacattcctgatgtcgcacctcattgatgacactatgcctgcatacatggaaacttgttctttgatgggaaccaagcccctgtataacgaagttgtcatgactgcaaccacgaacaaagctgctgaagtactggctcaagctacaggacgtccaacatctacctatcactccttccagggtctgattgttaaaaatgactttaagactggtgaggctaatgtcgtaccatctaaatcattcaatattaagaagaacaaaatcatcttcgtagacgaagcatccatgattgatcgtcagttacttaagtatgctcgtgaaggtactcaccagtgcaaactggtatttgtaggtgatgcttctcagcttttacctgttaaagagaataagtctccagtgtatgcaggtaatatcccaacacactatctgactgaacagatgcgtactgatgcaccggaacttaaagcattgcaccagcaattgcgtgatacggtggaaggtaagacaggcttcctgccaattaaatgtatcccaggtatcattgactgggtacaggaggaagagatggagaaattggttctcagtcacttcactcaacctaccaacagccgtattgttgcttacacaaatgaccaggttattaattacaataactacattcgtgaagctaacggttatgtgggtgaatactccatcggcgagcagctggtatctaactctgctgttcgcttgggtgtggataatcgtttatctattgaacaggacgtaaaactcattgaccaggatagtagtactcgcatgattaaggttacaggtgacctggaactggaagttcgtgatagtactcttgacctaggctatggtggcattgtaagtgaagttccaatacctactgacccagactacttcaaccgtttagttaagtggttaggtaaagaaaagaactgggaaccttacttccgtcttaaagaaaccattccagacctacgtgctactcatgcgtgtactgtccataaatcacaaggctctacttacgacacaatctttattgatgcaaatgacctctcaagctgtcgccaaccggatatggttgctcgtctgctttacgtcgctgtgtctcgtgctcgtaagcgtgtagtgttctatggcaatcttgccagtaagtacggtggcctaactttctaagggaggatatatgcctcagattggttcagcgactattggtcaagttgccaatagcagcgagatagtcaagcatctgttcttagcagaactggttcgtcttgatggtgtgttaaacggtatcattgataagaatgatcgtatcaatggtgtagatgtatcagctggattcctttaccagggtgagttctatcagcgttctaacgctaccagacctccaacctacggtgagcgattaacgcttaatccagaactgtggcctgcaatggacaagtatctgaaagcctccagtcgtttgattatggaagtacaccttgtgaaccagactgtatatcgtctggttcgcggttgtatgtcctatcaggatgtacgtgatgctctgcctgagtgtctggtagcacaagaccagacgggtcagtacaaaggtctgcctcgtactcgtgaagcagcctggacacttgctggtgatgctatggcaatcaagcagtatgagaagattctgccctctattgagtattatgcagcttcccatctgattttctaaggtaaagctatgcgttacatcacctctcaagatactggtaagtatcctattgctatcctcggtcatcaaatccgaagggaggagatgattaaaacctacctgctgccttatgacctaagcatggaagacttcatctttattgaacttcattctgcccctggcaagaagaagactcctgcaagggagattaaggagttcatacagcaggaattacagcaagtactggatgatgcagaaactcaatatattatctgtactgattctgactacttcaaaatactgactaaagaggctaaagcagaggctaacctcggctatgtttgtgattcagtatggggtaagcagaaggttatctatacgcctagctacaggcaagtcttttatgacccacctgtagtgagagccaagattgctcagggtatggatgcattgcttaaccacattcgtgggcagtatgctgaaccaggccagggaatcattgagtttgaagcatatccggatactccagaaaagattaaagcctggctagaccagttgcttgagatgaataagccattggctatagacatcgaagcattcggtttaaagcactataacgctggtataggaacaattacattctgttggagtaagacgcaaggcatagcctttaatgtggactacgagccaattcctggggctacagaagcaccatatgggcgtatcaacagaaatgatattgttcgaaaccttctgcgtgagttcttcattaagtacacccaacggcagatgtatcacaacattagctatgacgtgtacatacttatctatcagctgttcatggataacctgattgatacggaaggcttactgcacggcatggagatcatgctacgcaattgggactgtactaagttaattacctacttggctactaacagttgtgctggtaatcaccttagtctgaaagaccaggctcaggaatatgctggtaactatgctcaggatgatattaaagacatacgtcttatacccaatgagcaattgctacgctacaacctcattgatggattgtgtacttggtacacttatgagaagcactgggatactctcattgccgatgaccaactagatgtttacaacaacatctttaaaccagcctgtgaagacattattcagatgcagttaaccggtatgcccatgaatatggaaaccgttaaccaagtagctgaagaaatggaaactgacaggaaccaggctctgaaaactattcgtgagtctaacctcatgaagaactttaccctgatgcttcgtcaggaatgggtagacgataagaatgctaagttgaaaaagaaacaggtaacactggctgattgtaacatcgagtttaatcctaactctagtccacaactacagaagttgttatttgattatatcggcttaccggttcttggtcttactaagagcaagcaacctgctactgacggtgacactattaaagcactgcgtacacatacgcagagtgaagatgttaaggaactgctcaatgcacttatcgactataagcttgtggataagattatcactagctttataccagctttcaggaatgcccaaccgggaccagatggctggcactacctgttcggtaacctcaatctgggaggcacagtctccggtaggttatcggcttcagagccaaatctacaaacaactccatccggctctaaatatgccaagaagattaagaaatgcttcgaagctcctccaggctggatattttgcggcttggatttcgcctcgctggaagacagaatctctgcactgacgactaaagacccacagaagcttaaggtatataccgatggttatgacggtcatagtcttcgcgcatatgcttattttggtgagcagatgccagacattgaagacacagtagaatccattaactccattcagcataagtacaaatcattgcgtagtgactcgaaggctccaaccttcttacttacctatggtggtacttatatgggcttaatgaaaaactgtggcttctccgaagagaaggctaagactacagagaaacgttatcacgatctctatgtagttagtgatatgtgggttcaggctaagctagatgaagctgctaagactggttatgtaactgctgcatttggtttgagagtgcgtactcctttactggctcaggtattacgtgggacatgtaagactccatatgaagcagaagcagaaggcagaactgctggtaacgcattaggtcaaagctggtgtctactgaataaccgtgctggctcagagtttatgcgtaaagtcagaaccagtgagttcaggttagatatacgcccttgtattcacattcatgatgcccaatacttcatgattcgcgataacatggacaccttgcagtatacgaacaagcacttggttgaagccgttaactggcaggatcatcctgatattgctcatccagaagttggtttgggtggggaactatccttgttttacccaacgtgggctaatgagattgaaattccaaatcacgctaccccagaagaagttcatcaaataattcaaaaggcattcgcatgaccaaaagtactaaagaaactgtagtcaaaaagtatcattggatggtggcagcacaggtaatcttccagcttcctaaagctgatgatggctccctgcttaccatgaacacaatgctgctcactgacgaacctcatgtgacctataaagatttggctcgtgccaatcactcactgaagattagtctggatcagcgtttcgatacctcagttgatttgaaagatattgtttatctatctattaacaacctgggcctgatgtctgaaccagagttccaggcaaacatgattcccaagggggaataatgactaagctctccggtggtcttaataactactatgtagttacaattaagaatccccaacggaaagagcaagagccataccaagcagagtgtgaggatattatccaagcactaggcatgaccttcgatgaaggttgtgcctttaaagctctatggcgaaatgctgctgcccgtatgggtaatggtaaacctggaaacacttcagtttatgactgtgagaaattggttcattacgctaatcgtattcttactaaagagaagttagtagatgaattacctgccacagatatcactgctactgggagatgctggcattacccggggaatggaaagccttatctaacagtgaactttcagttcattgaggtagcgtacaaaggtgaactagataacatagtcagctatagcttcgatgaggtagagagtattcgttggaaccaggtgcatagatacaggattacttactgatgaagataaccaacaaccatgatgtctcgctggccctggctgtatggctattacatgacgagtatgattatgtagacaatcctaagtatctgtctgtaaccacactgcttaagccacttaagcaaatcgtcatgaagcatcgtgtagacctcagtgaccagtcaattgatgttatggattttgtctccacatcaatgggtactggcttacacgattctattgagaaagcctggaagttaggccataagactgcattgaaaaagttgggttatcctcagcgagtaattgatgcagtagtcattaacccaaccaaagcagactttgatgctaaccctgaccttatcccaatctacattgaacaacgtggaaccagggtagttaagggttggactatcggaggtaagttcgacatcgtaacagaaggtctattgcaagactttaagtctacctcaacctattcctgggttgctggttcccgtgatgatgaacacaagatgcaaggtagcttgtaccgttggattcacaacgacatcattaccgaggatgtaatccgtattaactacatcttcactgacttcatgaaacacatggctaatagcaatccgaactatcctgctaatcgtattatgcataaggatattccgttgttatctgtcgataagactgaacgttgggtagaagagaagatacatctcattgaaaagtactgggatgctcctgaagaggaaattcctgaatgtactgatgaagagttgtggcgaacagagccacaattcaaatacttctctgatgcttctaaggtagatatgcctggagccagaagtaccaaaaactttgacgatatggcatctgctcgtatcttcatggctgaaaaaggtggcaagggtgctatcaaggtcgtggaggggcaggttaagcgttgtttatactgccctgtcgcatccatttgcaaacaaagagagagatattttccatcatgagtattgaccttaccggagtagtgcatcatcaggcgattgaagaaatcgtagatgtgctctgcaataaaacccagaacaatgaccggggattcttccgtgtcgaagtagcctacttcttggctaaaatggcatcctgcatgggtgcaaccatcgtaactaaagaccgtggtgacctgccggtaaacatctacgctatagcgttggctacatctggtttcggtaaaggtcactcagtaaatatcatcgaagacgggttcatgtctggcttccgtaaacgctttatggaagacaccatgcccgtcatcgcaaatgatcgtctatggaagattgctaacgaacgttctgctcgtcagggtactgaccagcaggaagagtttgataaagttgaggcagagtataaacgtgcgggagcatatccatttacgtttgactcaggtactccaccagcagttaaacaactacgccataagctgttaatggctgggtgtggttcaatcaatcttcagattgatgaaattggttcaaatctgttggctaacatggatgtactaaccctgttcctggagttatatgaccaggggaaagtaaaacagaagctaaccaagaatactgctgaaagcgttcgtggtgaagaattggatggcaaaactccaactaacctgctgctatttggtacaccaagtaagctactggatggtggtcagactgaagaccagttctatggctttctagatataggatatgcacgtcgctgtctgtttgccactggtcacttagacaagagagcacatgcaacattaaccccggaagaaatctaccgtaacctgattaaacaagataacgtacagactcttggtaagtgggctaaccatttccatagtctggctgacccaaacctatttggttttaagatggttgtagaagataccgtgggtattgctctgattgcttacaaaattgattgtgagaagcaagcagaagctatggctgaccatgaagatattcgtaaagctgaaatttctcaccgttatttcaaagcacttaagctggcaggtgcactggcgtttgttgaccaaagttcattcattgagatgacccaccttaaacaagcaattctgcttgtagaagaatctggagcagcatttcagacaatcctcaatcgtgagaaggcttatgtgaagctggctaagtacattgcttctgtaggtaaagaagtaacccatgctgatttggtggagtctttgccattctataagagtggtaatgcagctcgtaatgagatgatgactcttgctacagcatggggttacaagcagcacatcatcattaagaagaccttcaatgaaggtattgagttcttccgtggtgaaactcttaaagagacagacatcaatgagatgattgtggcgtatagtgatagctttgcttatgactacattggtgaacgtgtaccgttcgaccagttgcatgtattaacccaagctcccggtatgcactgggtaaaccatcacatgaagaatgggcatcgttctgaagaaaatgttatcccaggatttaacatgattgttattgactgtgatggtggagtacccctgcatacgtgccatgaactaatgaaggaatataagttcatgacctataccaccaagcgtcatactgatgaagagaaccgcttccgtctgattattccaatgaactatgagttacacctcgacactgaggaatacaaagagttcatgaataacgttatggcttggctaccatttgaaacagatgagtctgctaaccaacgagccaagaagtggatgtcctgtgagactggttcctatcattacaatcttgatgcgaatctgttagatgtgcgtgactttattcctcgtactagtaagaacgagcagttccagaaccagatgaaggaagtacagtcgttggataatctggagcgttggttcgctagtcgtattgcctccggtaatcgtaataatcaaatgattaagtacgcactggcattggttgacagtggttgggacttttctcaagtacagcaagccgtccacacattcaataagaaactggctaatccattaccagatgatgaattgaatgcaaccgtaatggtcaccgtggctaaacgctacgctggcaaataagtaaacaggagtctttctttggtttgaaggactcctaaattaaacgaggaaaaataatgtccgaagaaatctccaatgatatgaacactcagctaatcctgattgcaggattctcagcgagtggtaaatcagcatcactgcgtaacatcaggaaccaggaacgctggctctatctgaatactgaagcaggtaaacgtctacctttccgtaacaagtttaatacctacaacattgaagacccatatcagatttgggaagcatttgatgttgcatccccaggtggtgaaatggcagacgatgttgatggaatcattatcgactctgctaccttcatgatggatatgctggaatctcagtatgtactgccatctgctaatactcagaaggcatggggagattttgcacagttctttaaaatactgctgcaacagaaagttgttaaatttggtaagccagtaattattactgcccatgccaaagatgaactcgacgaagctgctggtgtgattaaaacattcatcccagtgaaaggttctctgaagaacaatggtcttgaggcttacttctctacagtggtttacgcagagcgtgtagacattaaagagctggagaagtatggcaacaagatgcttgaaattaccgaagaagaacgtgacttaggttataagcacgtattccagactcgcccaaccaagaagtctgttggtaaacgtctacgttccccaatgggtatgttcgataagtctgagacttacattgataatgatgcccagaaactcttagaccatctggctgaatactacgcttaagcgtttgcctggttgttaatcacttattaggaaaaatattatgtcactgttcagtaacttgaaagaaaaaaccaaaaacgttgaagctgtaaaagactcccttggtggtggtggcttcggtgcaaaggagtcagatatctacaccggtactgtaaaagtagcttacgtaggtaaagctgactctggtgcagactggatgcagttaatcattgaaaacctgaaaggttctgatggtaatgatgctggcgagttccgttcacaggtgtacttcacttctggtaattctaaaggcaataagcctacttacgagaagaacggtaaagaatacttcctgccgggatacaccgtcattaacgacatgatgctgatggctaccggtacggaactgcctgaagctgacttcgaagagaagattgttaaagtctatgacttcgatgctaaagcagaagttaataaatctgtcatggttccagtagacctggttggtcagactgttaccttcgccctggaaaaggttctggaatctaagcaggttaagggtgacaacggttacgttgattccggtgaaacccgtgaagtaaacgagattcagaaagtgtttcacccggaactgctggtcacagtcgtcgaggctcaggaagcagagaaggctgagaaagaactgaccccagaactggctgtattttatgcagcatggttagaaaagaacaagggtaaaacccgtgataagaccaagggttctgctggtggtaatggcaaaggtggcttgcctcctaaaccaagtgctggcacgggtactgctcctgctggtggtaaatcactgttcggtaaacgttaatgaaaatcccaattgttggtgcagacattagtctccgcaattggggtttagctcgtgggatgctggacattgagtccggcgtcttcgagcaggtcgaacttaaactggttcaaactgaagttgaccacaacaaacaagttcgaaccaactccaaagatatacaagccgctcacgatttgtttcttggttgtgaagaatggttacggtctgctaaagcagtattcgtagaagtaccagtaggctctcagtctgctaacggtatgaaatcctatggcgtatgcgtaggattaattggtgcatttcgtgcattgggttgtccaatctttgaagtatccccaattgaaaataaacttgcactggtcggtgataaaactgcatccaaagacacgatgattcgtgctgcccatgctatctatccagaagccaactggctcacagataaaaaaggtaaacttctgaataagaatgagcacttagcagatgcaatcggtgcaatccacgctggtgtaaatctcccagctttccaaaaccttcttaatttaataaaggcgtaatatgcaaatcattttgaaccagtccgaagtagaagctgctgtacaggcttatgtcgatgatcaaatcaatcttgctggagacattagtattgtcatcaatgcagatggtacagcctccgttggtattaacgaagaggtaagtcataacgatgatactccacccttggtagagaagaagacacgtcgttctcgtaagaaccctcaggaagctaaacaccgtccggtagaaccggaaccagaagaagtggttgaagaggtaaagggagaagaaacccagacctctactggtggtccgaacaagagttctacgccggaacctgaagaagaagcagtaactgaaccagaagcacaagaagaagttgtgcaggaagaggttaaggctgaagaaccagcagagaaacctgctactaagccttcactgttcgctggccttaaacgtagttaatctggtaggtggctcagaagctgctgctaggtgtggtagtgtttatagtcctgatgctactactggtcaggattatagacgtgtcggctccatacatagcttttatcatcactgtcattatcctgtggaaatgcagtggtaaacacggtggtgacaagccgccagagtaacaacaaccgaaccagtcccctttaatactctccgaaggggattggttcaaacagggttaacatgaacaaatttactattcactggctcaatggaaaggttagttctttcatgggtggagaacctgctgaaggaaaaaaaagcattccacattgactcagaaggctgcaaaatcttaataccgtatgcttggtataaagatggtgaagtagaagcattgaagaagagcagttaatatcgtgaagggttctgttagaatcctttgagataggaactcctatcataacctttcttaacttaatctttgccgtatggcactgacgctaggggtggccccccatccgtcagacagactattttaagaatcggttatcacagaaaatgtaaagcaacattcgggttaatcaatggcctcttcctataggggccatttctgaatcttaggctatatcccaaaggttagtatctttaggataaggcttcagatcccttatcaaactaaccgctcaatgttgagcattctaatcacataagcccctatatgggctgggttaaatgtcggatagcctagctacctacaacatcgaactgttagatcttacatgcaatatagggtataaagggaggattcgtcccctcccccctattatgggctatcggtgagtgcattagttgattagctgtggaaggtaggccgatgtccacaagcgtggcccagagctagtgtactctccgatagttttcgtaagcgattatgcggttttttagaaacgaaccaataacataagtgcaaacgaagaagcgtatctgatggcagcttaataagccaagcgtcagtcaggagtgagtcgtcctgattatcaaacgaccgtggagttctcccgtccatgtattagaaacgggggactaattatcagttgcacgagatggcttgacatgttcaagtttggactaagtgtgacaccgctagattggagggctgctgcggtaagctatagactccaaccggaggttcgaatccttcactgataaccaattcaaagtagcattgtatatttaaatgtttcccggcatttaaagcacccaccgtgacagtgctactctaaattggaagaattatgggggtaagtcgtaaccatacgacggcgtaagtaccagatgagacttctggacgcccctaccatatttgaggtgtaacagttaaatccagttgccggaagtgcaattctagatacgctgccaatgtgtgaacggtaaggctgtacaggactcggactcccacctcaaaccaaagtcgccaggtacttatggcaaacgggtagtaacgaactagtcattcgtcaaacgcccaacccaattatgagtcagcaagaacgccttcacttaaatttaaacaaaaaagcttaacgcaataattatgtaggggtatgtaaggattgcgaagaaggagccagttagagtctggcatgactcacctattaatacccggtaggcttagtggtaaagccccactagtaaaccaactaggacgcaggttcgaatcctgtccgggtaaccatattatgtccgcttagcttagactgggaaagcaaccgactaataatcggaaagtcactggttcaaatccagtagtggacacccatttagcagtaacatagtcctgattgcatcgcactctaaagacaacactggtaagacagtccagtggctgctattgtattgttattcccttcgacgggaatttcgctggagaatgggaactccttaaatcctagcctgagtaattaccacaggaacgggactatcaatcccaagcctggtcagcgtggactgtcttcgtggtaagaaccaaaagcctcccagctatgggtaaatagtactaagtcccctggagccgtcactctgggggacttttttatttgagtattaataattggataatcaatatgattgacctaatctcaaccccgtatgcctatgaggtaacggataatcgaggacgcaagtctttggtgtttgcaggtagcgtagcctataacaacgcagtcatgtttaagtacaaactcaaaccactctatgaggctaataatggcaacagtaagtaaagaagcaatcgaagctaagattaagagcgtctactattttaatggagctgatgcagtgaagtctgcatttgttgatccatctgcactcccggcagatgatttggctaacctgggtctgataacctattgcattatcatcttggaaaatggcttcaaagttgaaggtgtatctgcctgtgttgacccagctatctatgatgagcaaaaaggccgtcagtatgcatatgaaaatgcattcaataagatttgggaattagaaggttacctgctacgtcaggcactgcatgagaaagaagagactgctaaagctctggcttcctttgcagaaaacaacacctgtgatggtggtggttgtacaatctgattcaaaagtgtaaggtagtttttaccgaaaggtactgaactacccgacatgtggtaaggctcatgaagccaaaacaaaacaagccctcctagtgagggctttctcatttgaggtagttatgtcagaagaaattaaagtccattttaccaattatatcggaaccaagtgtgtaaatggtttccgaatgaacaaagaaacatactgcaaacttcgtggctgggatgtacctgctaatgaagacccattagaagaaggttacttagtagagtacccagactctaagtctaaccatcctcagttccgtggctatattagctggtcacctaaatctgcatttgaaactgcgtaccatgacgtagaaaaaggttgcacctttggtcatgcagtagagcttctcaaatccggcttcaaactagcacgtaaaggctggaatggtaaaggaatgtacattgagtacgttgctgctcaagaatggaatagcagtagcttagagcgtacaggacttgctgatgaattgaaacctcgtccatggttaggaatcaaaactgttgatgaccagtttatgccttgggtcccatcccaatcagatatattagctgaagactgggtgttagtttagtaaaaattaaagcccctctaatgaggggctttttcatttagttagctagattgagccaagggttaaggttatgggcacgaagtccctgaccgaagccccaggagtaaccgagattgccttgtgcagcaatactgaagatgttgtcctgaataggtaaaccaacattaccaaacatggtaggagttggagccaacatagccatagctgcgtgtaccgggttgttacgaatcatggatactgcaatttttgcagaacgaatcttaaagttatagaaccacataagaccaacactttccatatacccacggaagcgaccaggcagacggtcatagttaatgaactcttccgttacacgtccaagtgcttcttcacgagtcttacctttacgctgagtcaaatcatcatagatgattgctttagcaataaagtcagagtactcaaccgtcttctggataccctggaataaagcagtatccttggtgataagggcataacgtccagcattacgtacagacttaggtaacttatcagccagtttatccatgtattcgtgaagtttaccttcagtaatcaggatgtcatctcgtccaataccagcatctgcaattgaagaaaactcaccagcttctaacagaggccagatactcatacgcttatgactatcagtgatggactgaatttcagccttaagcttacgaatctggttcgggttagtagctgcacgtaactctgcttctgcatctacctgacgcagacgagatttcaggtactggttaatctcagcagtcttctgtggaatgctcttagcaatgttcttaacaggtacaccacgaccaaccatctggtaaaggttagccaggaagttaacagcaggaacaactactgatttaactacaatcagagtcttagcttctttaactaagttttgaaccaggttctcaccacccattacatacttataagcacggttgccgaatacacccaacatagctttcttgaaggtatccagtgtttctggtgaccaacgagaattgccagaccaggcatcacctacggaagctgcacgatagcccagtgcatcattcagcatgtcacgacgtacccacaactcaccaggaccaaacagactttctgctttctgacgagtttcactgttcatcagcttaagggcatcagcagttactgggtccagtttagaaccaagaaggttaacgtactgtgacttgttagaggcagacattttaatgtcgttttcatacatgctatgcaggttctcaatcagcatatcattgaaacgctgagccttagcttcctctacctgacgaccacgccatacaccaattgcacgagcaagatggttctcaccctcaatgtgcttcagcatgttagggtcaatagattgctcatatgcaactacattacctttgtcatcatatacaggcagcagtggttcattaccacgctcaccacgagccagtgctttagtgatgcggtctacggaaggcttgtcagtgatacgaccagctaccatagaacctatcgtaaagcctgtaccaaggtctacaccgccagcagtattgcgaacgttctgtagaataccttgtgagaatggagcctgtgcctgtacaggtgcgaagtagtaactacgtgctggaccacgactagcagagctaccctgataagtacccagacgtacataagacttctcaatcaaatcagcaaactgactatcttcagcaacaatcaggttaacaccctgtttagtctcaccaggaatgtaacctttatactggttcagggttgcacgcatgtcagatttggctttagccatttcatctttacgctgtccaaccagataagaagtagcaaaatcaatcccatcagcttctgattgagccagtgaagataacatctcacggtcagtcttactcattgcttccagtgcatacagagtaatcagtttatccagttgagctacatctacagtagaacgtgcagcctgtcgttcacccagcatacgagagattgcagtagcattacgcagcaagttattaccaactgtgccattaatcatgtactgagccagttgcttagatttacggctaatcaaaggccagttacgtcctgcttgtttctgcaaatctgcttccagcttattcacttcacggtcaacaatcttttggtcagtcagcaagtcacgaatttcacccagagacatagtgtcacgcagaacagctaagtcggttttacccataccggtatgcattgctttccactcatcattagtaagcttacggctgaacttagatgcaatagtggtaggcaaatgttcacggaactgctgacggtcagcctgtacctgtgcacgcactgctttaatcaaatcatatacagaagcattgctcttagtacgaccagttaagtcattaaccaggtcatggaaaggttgccataccttaccctggttcattgcagccataacaccctcagctacgattgcaccatttttctctgtagcaatagcagctattagttgtgcagcatgagcagcacctttaaccaacgggttcttggtattagctgcaacttcacgagcaccctctaaagcacgggtagacagtacatcaatagaatccaccagatactggttagcacggtcgatagcattaccactaggagtagcaatggaatcatagaaggactgtgcattgagactcgtctgcatgattgtctgagccagtgcatccataccttcctgtacgttggtagctttagtatctcctgctacacgagcattcagactagccattgcagcagtaccgatgttagtcagcattgcatcagcggtattgccagatttcttgtctactttcataacaggaatgtcagccagtactttacgcacttcttcacttaccattgccagaccaacaaaggtaggcagtaaggaagaacggccttgtgcatcaaactcaatgttgttagcacccatgatggtatcgaacttctgctgtgcatagtaacggtcagcagggttagtactatctgggtcagccatgaatgactcaacggtcaggttcttagtaacatgtgtgtagtattcctgtgcacgagccagagcagcaggattaatagcagcttcagtagccagtgcagcaacaatgttagtaaagagacgttgttcctgcatattcatagtgaagccatgagcctgaacatcacgagttactttagtcgcattaaccactgcatcagagaacttacctttacgaattacttgctgtactggttcagaaccaatgtagtctgtaatcagtttatcaaaggttttccctagctcttccagacgagtattgtcaccatatgctttgttatggaacaaagtagtatctttggctacagcagcagtaggtgcttgaccacgcataactacagcagagttaaacagtaagcctgagaacatatcatctgcattagccggagctttcttacgcccgaataccagacgtttgattgcttcatatacagcctgaaccatggttttcagtgcagtggttttcttctgcttgctaatcaattcacggttggttaaaccccaagccatgtactcgttaagtgcagcagctttagccattgctggttcaatgaagccattagacaaatgaccattaatggtattaagagcatctgcatatgcttcacgtactgcaggagtttcatccttaacatccagagtgcggaactggttcatcaggtcttcaatgttctgaactgcttcattaggagtaccttcatagtgagctagtacagattcaaaagtagaagcatgcaccaattcatgaaccagagtctctaaggaaggagtaactaagtagatggtcttatcttcaaagttagtccaaccgtatgcattacctgcttcagcagcttcaatatcttcaggtgctgggcgagtaatgttcttctcaatagcgtaagcatccagttgaaaaggggttccatagacaaccttgtagtctttagcagcaagagatttctgtacttctttcaatactgcttgctgttccggagacatctctttagccagcttagagatagcagtattagatagtagacgtacaccagacttcagtactcgaccaacctgttccattgccggtgcttctttcactggttctgttttagcagcacgtactgcatcacgacgcttgtttaactcagcatcaaacagttcgttcagcttagctacttgctggtctacagtcagaccttccagagagattttaccgttgttcacataaggagcaccaacagcagccatctggtcaacagtagtctgtacctggttcattactttgtgacgaatatctacacccagagcaatattacgcaggttacgttcaatctgttcagcaccaacacgtaacaggtcatcggtagctccttcacgctggtcatattccagagcagatttagcgatagcctgtttggtttcatcagacagtttgctgaagtctacactcttcatgaacttagcgaaggagtcataaacattcttgatagggttaccctgccaggaagtgtatacagcctcattagctttacgacttgcatcagtgatgttgttgataccaatgttcataccatcaaagattttcagggtattcttcggagcacctttcatagtagaaagggtctgcatcatcatgccatcgccagtaccaatggtcataaaaggaatacctgcaacacctgcctgtgaaggagcatagatgctcattggcacacgcatacggtcatctaagttggtagccagtacttggttagcaacatcagtgttttcactaccggcaatgtagaaagtctgtgaaccagtctcaatcattggagctagtggggataatgattcctggatttcattcagttctttctgtgttaagaaatcacccttcttccaggttgggtctttttctttttctgccagcttagcctgtactgcttgttggaacatgtcttgtagaaccaaagactgaatctgggtagccttctgcaagttctcagtagaatgcatcagaccttccccaacagtattccggataccagtacgcattggttcaacgaacaggtgaagcatgttctcttgtaagttcttcagggcattacccgatatggtaaacttctgagggtctaacttaccagtcagagcaccttctacctgttgaatagacaattcacctttacgcataactggaacattaccagtcagtgcttccatagaagtaaggaaagtatccagcatagcctgagcatcagcctcagacgcagcctccttaccaaacattgccatagctggggaaatactagggtcagcagcacgagcttgcagaacatcactgaagcgttcatagatggtatcagtaattgcactaaccatcttgccagcaataccacgagcacctgaaccatagatggtaatggtcagtgggtttttagcgataccacgtttcaggtccagagtaccgtcttcattcaggttaaagtctttaataaacaggtccattaacttctgaagatgattcatttggttcataaccggaacgttgttacggtaagtagtacgtaactcattaagtgcttgttgcagaccattggtagatgcttcatacaggtcaacactgtcatcctgtgaacgatgttcattcatagtcttaccagctttaccgaagaacagaccacctttagcagtattcttaatccagtctgaagtgaacttaccaccagtcattaataccattgcgttgattggtccgttggttacaccatcggcttcaacgtacagtggggtattaaagttggcacggtcatcactgttcaggtaacgggcatattccataagagccatgagagctacgaatgatttatcgccacccaaagaagtcttcagaatatctactgcatcagctggtaagtggccagacttatcaaactcaaccatcatatcaacagcaggtttcagattaccttccagagctttggtcagcttttcagacatagcttcacgggacatattatgtaccttgatacccaatgcctgagccagtcctagctggaagtcagagaatgtttggctgttttcattactcaagtcaatagtagagaaggttggcagaattgcttcacgaaccagtttactggattgtgggttgttcttacctaacatctgcatacgacctacacgggtcatgttgtaaccatagtgaataggcgtatccagaccattctcctgttcctgtaactggttgattacaccgaacagggaatcatatgccatagacactgacaggtttttaccctccagtgacttagcagtgttcacgttcagcagttcaggattaagagtaccagcacccatcagttccagaatgttgtcacgacctaatgcttcatagaagttaaccatcggcatgtgtacacggaactcggtagcctgttctgctttaagagcagctttctgctctggggtattcttaacagcagggttacgtaactgagtttgagccacggaaggaatatcatcaccaaagtacattttctcttctggttctacgagaacagcttcctcgatagcagtaggaaacttgttaatggcatcgttatcatccagcttctcaatggtatacagaccgacggtcttattagagtctgggtcaatctcagacacatcaagcatagactctttaacttcacccatctcaatgagagaagacagaatctctgtagccattgccattggaatacctttggtataacccagtggtgcattaggattacgattcaatccccagtaagattcaatcttttgagccagtgagttagtagcttcaaccagagtctgagcattctcaaattcagccaggataccttcaggtaacaaggatgcttctactccagtaatagcagctacatctttcatgtctttaacagcagcattctgtgtagcagtcagtcgccattgcagaccagcaagtacagcagtctctaacaactggtcattgaacttaaaggtgtctccgtctttctctacgatattaagtaacttaccacctacccaacggttagcctctgtgccttctgcaaagcgtttaccaacgttcttattagcaagaaacttagccagacgatcagacagagtagtcttcagagtttcaccaaagcccattaagtcctgataacgcttaatcacatcacttgtgagagcgttattttctttttgagtgaatgcttcaaagcgtgcagtagaagacagtgcttgcttaatatcagtcaaaggggattcagaaccaatggtgcgagacttaggttcttccggcagggtaaatgatttcaggaactggttcggtgtcttgtcattgttatagacagggaaaactgtttccattttcgttttagtttcagctactttttgagtggtatcctcattggtgagggtagcatctactgtttcagacttagtagtagagacttcttctgcttttgaactagcctctttaacaggaacagtcttattttctaccactggtttagctttaggctgtacagtagtagtagtctcttgcgctggtgcaggagtttcatcaacctgattcactggttcattggtctgttgagactgagtggcatcaagaccaccttgacggaactctttaactacctgggcagcaggcttgtccagacgtgaatctaatggagtaaccttcacatgagaaacattaagctccgggtaagccgtagcaagtgcgttagcaatatcagctacggttttggcctccagtcctacttgctgggcaaacttaaccgacttggtatcatacggattgacaccaagaccagtacgactacgtacccattcacgggagggagtaagagcctgataatggacagacttattcttatccgcattcccagaaatcagatgctcattcaacgctccgaccttattctgcatgtgctgggcgaacttcataaagtcgtcgaggtaagcggaagccaaatcgaagttaccagagttgtacgcagaacgaatgcgtttagcatgttgcaacgcagagtactgaccttcattagaacgagactcgtcggttttaatctgtttactaacaatgtcttgaggacgtaagcctagttcttctgctttagcgtcaaattctcgtgctccttgcaatagagcagcagcagattgcagggcagcacgctgatgattccccagtgtaatcttaccttcacttgcatgtttcagaaccatgttcactgagtctgcatccagtacttctggagacatatcagcagccatagcaatgttgtttgcttgggcttggttagcttcttcggtagctttcagtttacctgcttcagcctgttcctgaatcatagaatggatggcacggaatgcacgaagtacctttggtgtattctgaacgttagccatcaggccggagaactggtcaacaatattagcagcaggagaaccctgttccagattagctaaagcaccaggatcacggttaatgaagctatccatagacatgatgttgtcatacatctggattgcagcttccatttgaacgttagggtcttcggcagtattaaccaggtcagccatcttctgaatagcttcaacacggttagtggaaccagaaacagcttcacggattgctgggttagcttgttccagttctactgggtcaaatttcattgcctgagttaagtcagcagcatactgagtagcagcagctttctcttcaggagaaatatccattgcatctactgcttcttgtacagttgcttgtgcttgttctgcttgagcagtagcttcttgtgcagcagcattaaccgtagcatcagatacaggggaagcttgttcattacgcttagcaacttcttcgccacgctgaaccaggatgttagtaataggagaggcagcttttgctaatgcactaccaaccagagaagcaccagccagagtagtacgtaaagcaggcccagcagaagcaccaacagctttaacagttgtacctggagcctgagcaacaccagcactaccgaagccgtagagtgcaccaagacctgcttgctcaccgacacctttaagcaaatcacgcttagcatctacattaccctgaattgccttgttctgtgcaaactgacttgtaccagactgaataccttcttctactgtttcacgtagcatgttagaaccagcaccagccagcgaacctaccttaagtgggttaagttcaaatttggataccagaggaccagtagcagcagcaaccggagcagttaagccagcagcaatgatacccgtttcagatgcagtttggcgacgtgcttcatcaggagataaaccatcagcgatatgctgttgataaacaggagacttacttgccaattcttgatgggacatcttcatgatttcggaagcagtctgttggtatgcaccaccagcttccataccaccaattgcaatagcaggtgcagcaacacgaccagcagacaatgcaacctgtgcaggacgtgaacctaactcagcagctaaggtaatacccttaacagctttatcaccacctaccattactttaccgagtgcagatacaccacgaattaatggaccaccggtaaagagagaaccaacaccttcactcagcccatcagtagcagccataccattatcaagcgtattagcaacagaatcaaaagcatcacgaccaatacgagacagagaggcaaccaaactgctctctccatttttaatgtcttcttcgtagagtttctggttcttttgtgcagaaatctggttctgattctgaacaaccttacgggtagcattcagagcatcagactgtagattgtgtaccccttcattcagccaatccataccggaagcaatggatgccccggcattatcattgaccagacctgtgccaagagcagcaatgcccccaagggtattagcaacaccaagaccaacaccagaaagagtatcaccaaatgcttctgcgttagtacgttgtttagataagtcctgacgtacagcatcagcagcattagcccggctattaagaatctgtagaccttgctcattaccgtatttattaagaatttctaatggggaggcttgagtgaaatctgcctgaagtgaacctggttcgaatgcaccgattccaagattacctacacgaccagtttggagattgtaagcattctctggggttaattggaaagggctttgcccttgtgcagcttgcttctgagaggttgcagtagagacatcgacttgcttagcattagtgatgctgtctgcgaaacctgccagacggtcaaatgttgacatagcatgtttcctgttcaaacttatatcgtatatagaaagcttactctacagtaagccagtgtaagaaaaaagccccgaagggcttttgttagtattaccgattttgtcttggttgcatatactcaggcaaaccctgtgcctgacgtaaataccgtgcagcacgttcttcatcttccttggctcgtgctctgtccacactagcctgtgaccggaaacctcttggagccaggttagatgggtctgcttgaacttgtgcttgagcagcttgtagcattgcagcagctttagtaacagcttcctgacgagcaggcaacaatgcagtaagtcctgtttgtccggtgttaatcttgttctgggtatttgtcagtgcagctacagcagcatcataagcagtctgtgctgcctgaatattctgcatggcttgagcacgaccaaggttacgcacactgccttccagtggttcaccacgttgtacaccctcaattaactgatctaccagacggtcattaagacgcataccattaccagcttcattggtaatgaatgggttaaccgcatcaatagcacggctaatgtaaccttcaggtacaccagtctgtgcacgttgcataacagcagcagccatagctggagacatattcccacgttgagaaatatcagttaatcggttaagtacccagttacggtcagcacccttaaagtcaccatccagtagacgattagcaatctcacctactggagtattatcggtgacagtacccaggaaatcggtattaaggctaccggtattatcctgcatagagcgagtaccaatcataccctgagccaaggtagatactgcctgatttccctgattattctgaagcagagagaatgggtcagcccctacttcagcttgggcaataacaggtttaatctgttcccaagtcatatccttataagcacctggggtagagttaggtaaagcagcccaggtatctttaaggttaccattcttacgagcctcaaaaatagccctaccaatcttctcctggttctcaggggaaagaggttggttctgccaatctgaaccaagaactttgggggcaaagtctttcaaggtagcttggttaatctgaaatgcaccaacaggagaagcaccctggttcgacttcataccatcctgatgcttgattacatcaccgatactcatttgagtaataggagtggaagtaccagcaaactggtaagtaacatcataaggggaaccctgtcgagtaccagcagtaccaggagcagatgtagtacctacgccattaccgtatacacctgggtaagcattagccagtaatccttgcaaacgtgcctgagcaaccggagacaggttcctgctatatgcctctgccaacagacgtgcatcattgggattctcagcaccccgggtaatctgtgacattacacccatagctgcctgactatcagcatcattacgctgagacacacccaaatcaaaacggttctgtgcttggttaatagcctgaccaccttgaccttgaagacgtcccatcatctccagttgctggtcagcagggagtgcagatagtgcctcacgggtctgccccaatgcagcattaatacggttctggtcaccagactggtaggcctcggacagtaaacgaatagctggggaagcactatctaatgcagcatttgtatcctgtaaacgaccaaagagataagcattatagtcattggttccctgctgaccttgttgagtcagaagagtacctgctcgctcatccagattctgtagagtacgctggtttaccagtgaagggtcaaccccctgaaacagtgcaccagatgccaaagcattacgatactcagtagggtcttgatactgcatagcattcatcatgacggcattgccagcctcctgcttggcagcgttctggaaattacccagtgcatcacttaagccggaggtggcgttacctatcatgctaccaaatgtgcgaatgctgtcaccaactccagagaagttaggtgcatcaacattacgccatgtaatttgagccatgatggtttcctattaacgggttaatttattagctgcaatataagcatcagcagtagactggtcacggttctctgctgtagcacggctacgagcacgatcttccagtgcagtgttataagacttaatctggttattcaggttagtgttagtaacactcttagtaaagttcaactggtctttggctaacttattagcctggaaaccactgtagatattagctaatgaaccaagtgcacccagtcctaattggaaggtaggtacattcaatcccaactgatcagctgaaccagacaggaaagaagcagggtaggctactcctgtatttgcccccataccaatagttgcacctgggttatagttcatagccggggtattaaagttctgattgttattagacatccaagacatagcagctggctgtggagttgggttgcctgttaagaatgacaaatccatggggattctcctgttaaacaaggtcagtattaagagtcatatcagagtagttgccaaccatgtctaaagacaagtcagctatatctgaaccagtcatgagagtacgtgacaagaatgaatccaacgactccattgacacgaattgcatggggtcaatcacaccctgtccagcagtaccgaacatctcttcatactgcttattgattgccatcatatcagtattgtactgctgcattacactctctgctttctgaatagtagcagccgtggatgcattaatatactgactaatgccattacccactgaactggtaagttgcatgatgttttgagcactcatcatttcaccagctaaagaggataaggatgtaccagtagacaaagcagtaccaacgttcatggctaccattgaggcaatagcagcaatgataaaacctagcttatcaccgaacagtgaagtagatactttagtaataatggataccagaatcattgcagctatggcgtttgctacagcaccaactattacagcagctaatccaacaaaaccaagtgatgcaccgactgcaccgtatgccccaagtatacctgcaccaccagcacctgctgtaaatacagagacaactacagctaccactacaacaacaattttaaatgccccagtctgataccacttctgcttaaccttcttatatgagttcatcactaagtaggagcaggcagtggataactgagtgctacgaaccagtgacattgaacggtagatattggtgtgcagtggaataatgaatccactctcctctgcatcacccattgcttcggcaacatcaatgtgcactgacttatttttatataccctgttgttgtgatttagacccagtactctaagtttacgataggtattattaccatcctgccaaagcaactcgtattcctgcattgaatagaatgtgtatgttacctcaagtttcttagcagaaccggagttggaagctgtccttatgttcttacgagtaagggttatatctcctgcatacctggctcgaagttgcccctgcttagcaccagaccatgcttgacctgaatgggtagtttcagatacatagttccagccaatagtcatgtcgtacttgtactgcttattactatgcaccctaaactctcgcttaggtataactgggtattctggcagtggtggaggtgttccaataatatgcccttcagtcctgttccaccattccacatatgtgtcaactgcatcatttgctgcctgatagcctgcaatcactgcttccagtgttgggtaggttgggtcaggtgggaatgcttcagtagccatctgaaagaaacgatagatgtattccttagcactatcctcgggggtattaagggatacaccaaatgaaccatagatgtactgaatatcacctatgtcatcattcttcttaagctctgtgactactttatcaatttttccaccagtagctttataaagggctttcttacagtgtgggtagattgggtcattctctacccattgcttatcatttctgattggaatgaatgggtagaatcggttatcagtagcttcagtctcgaacaaagaatctagtgcaacgttaccggagttctgcttataaataagcattttaggtgtactaacagcagtcatctcggtatcagtacgggtagtctgggatgagtacttacgaaccagtgtctctgtggttgtagtgattgtatctgtacgagtaacacctccacctatatcaaccacattagtagttacagaagtactggattgaatctcaccaaattttgtatgagtcattaccctgtcagatacaactacagtcacatcatcaggtttctcagtgaatcctctacgataaactttaacgtaagagttccagttatccacacttggttctgtgacagtactgtcttcatccggtctgccatcagagtaaacagaatgagtatgtatagtcttagtaagattggttgtgttagccgtcgtatcacttgagacggtagtccataacaaagtggaaggtaagtcatcctcatcatcatagacagtagtcggtcctactaccggaggattagtagaaggggacttatagaatgagtaatcagcatagagatataaagcacctggttcaaagttagtaggtgtgaatgtaatagtagagcctccatctaaggaggtcatagtgatttcattagtatcttcatcaatatctatgtcgaatcgttccatgattcgacttggagcattctcataaagatactggtcacaccattgctcaaagtcagcaaagccaatctctgctgcctgaacatagactgattcaccagcagggggtgtaatttgaccctctataacggtagggtcaatcttagccaatacacccaatgaagaaccagccataccaactactgaatcatagtggttcttactccagctggagaacagtcgcatacgaatacctggcccattcagataactatcagagatagtatctgccatagtgaatcctgtattggaaacaatattacctataactacagtcttcatatagttagggcgtttatgtatatcccctgccatgttatagacagaggatgctacgtatactttggtcttcccactgaataagcccatattagttcagcccgttgttagacttcagcttggtcagaatggtgtcaatacttgcgttagtgaaaccatttggtggattcaagccttcatcaatagtcttctgagtaatccatgcatcagtaaacagcttagatgctttaacctctgcatcacgttgataagaagtaatctgttgtgagtacaactctttctgtttacctacagaaccagtaacagtagctccatcactacgggtatcaagtgtctgtgcacgttgtgcttcagtctgctcagtaagcaatttaagctgttgaggtaacatctgactaacattaaacaatgcagcacagtatgtttcagactcagtagcaatcttcatcttagtaagagcatactcactcttagcagacagtgcctgaatcttagccagcacaaactgtgctttaaacgttgccagttgaacacgagcagtaactgcctgaatctgtgccatagcagcagcccagtatgcctggtcacgaccaagtaagaactgaacagcattgctcatgcaagattccatcatagcaatgtatgctttggtatattcaccaccggtaatacggttagctttaaactcagctttcagatgattgtgtgcagattccattaatgcatcaaacgtaccactaccaccaacttcacgggtagtgagtgattcattggatattttatcaatagcaccaaagattggggaagcatccccaccagggatatcccattcggggccagtcatatcaacatcaggaagggtaaagtcatcacccttagttaactcttctaggagtcggttagcttctacctcagcagaacaagacataatcattcctcttggttcaaaaagaaacggcccacggagttaccccagtgagccgtgttgaactgtagcttatacgttaatcgttcaggctaccagcagcaatctgtgcctgagctagttgagctaattcagcttcagtcaacggaggcagtacctcaatggagaactctcgtgcttcagttgcacgaatatccggtaagccattcttacctttacgggtcgtaatgttgatgaacttacgctctttaaggaactcgtagatacaatacggaatgtgataaccattgtcggttacttcaccgaatggaacaaacttacgcacagtacccatatattcgttagctacggtgataatctcacctggcaggtctttcttcttagggtcaaggttctggatacgtacacgaatcagtcgagtctgttctgcacgaatcttttgaccaagagtcatcttcttaacaccagcttcctgtttttcacccagcggattaacggcagcttcttctactactggttcatcttttacttgtgcagcttcaatcttctcacgaagcttttcaacggaaatgttgttagagaacttgatattcatcaacgttgcacgttgcttaagaacttcaagttcgctaggcattgcaatatcgttaacggtatcttcgttgccctgtacgttcacttctacgtcagtggtcggtttatcgttaatgctcatgttcatatttcctgtggttcattcagttttattaagagggggacattagtcccccttgttttatttcggactatttacagaggagcaacagtcttaatcatagccagacgttctgggcgtttaaccaggataccgtagtaccacttgatagaactgaagccagtttcaccatacgggtcattacggtcagcagtttctttaccaggcatcttagtcatgatggagaacttaacagacttaccatcagtctggaagccaatggtagagaaggagtcatcaccaactaccagcatcgggaatacgtcgtagtgttcctgaccaccaaccatagtagaacgatagcctgggttagaagtagcctgagcaccagcacctgcccaatgcagcatctcaggaacctggataatacggaacttgtcgatacaaccaacttcaccattcatcagagtaccggcatcagcatagtgctgaatttcgatgaatgctttgttaccgaacagatctttcatcgctttcagttctggaaccaattcagaaccaacgtacattacacgagtaccaccaagtactttggtatcagtcagtttagaaccagtgataatagtagtctgagtcggggtacggttctcagtaagaatctggtcaagacgcatcaggttcttataagaaactacagacggagtagaaccttcaccggtgatggtagcatcagaagtagcagcacctgcatacaatacagtaccagcagcagcaagcaggtctttctggagaacagcttcagtcagctgtacagcaccgttcatcaattcgcgagacaggtgttctttcagttgatcatcagaatcgaagtccagggactcttgggtaaattcgtagaagaaaccgaacttatggatggagccttcacgagacagacgggtaaagcctacacggttaacacgaccaccgttctctgtcagcagaggcagtttggaagtgatgttaccaacgtctttagaagaaccatacaggttaccattaacgatggtagcaccattagcatcaataccctggtcgttaatgttcttatcgtcgagcagaggaacgtactcatacaccttaacagtcttaccgtagttcttcggcatgttaatggtgttagccagtggcatgaagtactggtctttacgagactgaataatagctttcttcagccagtaaaaggtattcatctgatcggaaccagcaccatcaatgctagatttctgaccgtcaattggagcgttatagtttaacatatcgtattattcctgtttaaagactacccggtactgggagtttagcgaaatcttcatcactcatagcgagtgggtttacaataggtgttgctttgcgtgtagcagcccgattaagggaagctgctttagcttgctcactgttagccagagtctgcttaggttgtgctacacgcactaccggctgaactgctggtttaactgcttgtaccggctcaggcttagctacttggttaaatgctccctgttgtgcaaggaggttgccaacgtagttataagcctgaatgaacggagtacctaccggaatctgacctaacatctgaagacggttcacttcatttgcaatggtgtcataaataccattctcacgttgttcgtgaatcgtatggagtaagccacgattctgataaagagcatctttactggcagcatcccatgtcgagccaataacacctaatgtagcttgtccttcttgagtagactttaagtcgtcaatttcggttgcaaaatctgcttcggtgtcggtaacacggtgattgccaccctggtagttaatttcctcatctgggttaaaatccagagggtctgtaccagagtctttgagcaacttcttaatggcctcaggattcttcttatccaggtcaatcaggaaagagagtttgtcctcatccattaaaccgttgttctgtaacatcagcattaccttacggtacggctgaagttcttgcatcttacgagtatagttagcacccatctgcatcaggctaatggcctcctccggtgaacggggagtaatcattttgccgttagctttaaaaggagccatcaacttctcataaccttccttatagttgaagtcagcaggcagaccttcagactgtttgccttcttctttctgttcctggccgggttcagtagtagaaggttcagctttagtaatcggcttaccgttactatcaacttctgtgtcaacaactttatcatcaactttatcagaagttaaagaatttgctgcatcttcttcaactggttcggtttcaggggaggtttcttcggttggtaggtcttcaacagcagaggtgtcaacttcttcatcaggagtctgtacgccgttggtttctgggttgttctgagtggaagtatcttcctcagcgataactgctggggcttccatattcagaatctcatcatccgacattgcgagaatgtcggaagctgtggttgcagcttccgtagtcataggaaatatctccggttaattattcatcttcaggttcagcacgaactgcatcgagttcttcttctacctgaagaataacgtcagcttcgttttcgcccatacgaatggcgaggtcgagccaacgacgtaagtgaccagcagcttgagccatgttaagtgcatctgcacggttatttggttcaagcagtgggtcaccagactcctgcacgtaacgtgcacaatcttctacacagaactggcgaagaattactttacggaacagtggattctccagaagtttacgtacatcttctgcgtgtgcaactgcacctttagcagcttccagtcgatgttccagtccagcgattgttgattctttactcatgtgaaggtctgccttacaagttcatgccaagagccgatgctgggtcttggctagggtcatagaattgggaactaagtgaataagctgggtcttgttgtgcagctaagtcacgttctggtatagagttcccgttagtcaaagcgttatatccaacagcagcagatatgttgggggtagtttcaccttctttagtaggtgttgtcaacgccttagttatctgaaggttttggtttccttgggattgtgctttttgtttttccatatcacgagcatgtttagtaccagattcctgttccagataatccaggtctttaaggtcaccactagaagcagcttctttagctttagcattattgagtgcaatcttactttgtaactcttcattctcaagctgtgctttctgaattgccaattgcttaagctgttcttccatagggtctggttgtggttgccaagtacgtaactcatgagcaaggtctggcatacgtttaagttctgcaatcttagctacaagagataacgtaatagactggtcaactgtgttgcctagtgtttgaaccatgaagcccaaatcctgggacttctggttatcaatttcagcagtgttaatatcaacctcaatgtcgaagttacctttaaggtcttcacggttaatctctacatactgttcgttagtaatacgtactacttccttctctgataagaacacagcattcattgcacaaatcttagtaccaatgtctgccatacccttagctaatcgacgaaggattgccatctcacgtttagatgctgcatcaagtgcaccacgaatgccagcagcaacatctccgtaagctgaaccagttacgccgccagagaatgctttaacacctgttagagcttctgcttcctggttttgcatctgagtcattactattgcagactgaggcaactcagggaacttgtgttccataatagactggctaggatttccctgcatcggattatattcatagtcttgcccatcatcatatcgacgacggttcagagtatctaacatccctttaggataaccacgctgaccatttgcacttcggcctaacaggtcaatcattccacgaatagttgcaccaaggattgcttggttatctcccaacagttcagcatcagcttcaccgtaaagttcacgtttacggggcatgtagggaacaactactaatggtaacttgccatcagggaatgggttcttctccatacgaataagagtagaaccaatccaggtagcaacaattggttccagtgaaccatcatcattaatgtcatagaatccccagtactcataagcaactactttcttacgaagtgcatccttaaactggaagtcaccaggagttttgctttcatggtctgggtcagtaatgggactggaactctcccagtcaatcttatccagattgtgataacggtctttgtttttcataaggtctgctttgcaagtctcaaaggagataactgcatacagagccttatccaaatcaccattacagcttgggtcaataactacgttattagggttaagcatctcaacggtaggtctgttaaccagtgctttttctacttctacttcagtgacccctgtctgaattgcataagtagcttctccagtttcattgaagtagttaacagcttctttgatatcttctggcattgtttcgtcatactcacggggattctctgcctgaagctgcaaagcctgttggagaacatctgcttgttcctggttctcaattggatacaactggaagactggagtttctgttttaatcttaatagtcttacgttcccaaccgatacgagcaataccagtaccgtcatctacgacactatgcacgtaatcatctaccagttttactttattaagctgagtacggaattggtagttaagaactagctcattctggcgtgcagctaactcatcttcaaaagtaaccggagttaccttaaatagtttgttagacgagaggaatggttcagacaatggagcataacgccactctgcctgacggcgaaccagtctaggctggacttgcgagcgtcccttaacctttgggggtttagccttaccctttacttccattaaatcattccactcacgaatctgtgccatgattgcatcgtgagcaggtttagcagattccaaatcacccttcagtaattggatacttggttccttcttccagtccgttaacttctctgattgagccgggtctggtaaaggcttaaaagtgtcttggtgttccatagttattcctgttcaaaaagtttacggtcagcctgaatctgtttacccaactcaattagttggctgtcacggagtctaacagttgcccggagttcttcaaccaaacgtctgccttcttcaagactattgtcgagtctggctgcatggcttgcaagacttctgcactcaagggttccggcttcggcttgacgtttatataccgatgctcgtctttcagactgttgcatccggctgtcgtaatcactgctaacgcgagcaagctcgcttgcgtaattactctcagccgtctgcaaccgggaagtgagtaacccgacttcataactatggtttctttggagagcattgtatttgtcctgtaatttttgcgttgccttttggtcttcgaccttttgggcatcccatttcttttgaacagtagactgcccattggaattgccccaaaagtaaatggtggccccaaggaccaccaccagaagataaggccaacctttagagattagcatcttcattacatgcctccagtggcacattgcctattcggttagctacccaaccatacgtaaagtctggcatgtttaatgaggtatagtggttcagttgtttagcatcaagcagcttaatcattacctgacatgctgcaactttgccccgttttttctgtaatgctttatatgcattaacagtacttgtaccgactttaccatcaacctgtattttagggtagtctttgccattacgtgacatttcattaagagacatctgcaaccacttagcaggacgggttacaccagtattaacaccagcatctactagcttatgcgttacagcaggagatatatcagcgaaggctacgaagttaggtttaagtacatagtcatcaatgtatatctcagcagccatctctttagataaacccttcatagaaccatcccaaccatactcagtagccagaacttctttatgagtcttagctactgattgggtaataccatgattagtttccccacctgggtcacgaggattgtttacataacctccttccatatagaacactgcccccagaatagcagcgataacccctcccactgcaccaccttttgcagcaagtttctgtttagctttcatgtgaatcttcctttggtcggaatcgtattaatctgcctatgatgtttaaggcaaacagtgcgattgcaatattggaaccatggggaatatcttccaagatgtgacgaggtaatcctgtcaccattggttggatgatatctacagcagagaatagaattaaaccaaacgtactaatttgaatggatgcccatttccagcatcttttccagttaggtactaactctacttttctttttagcctgcgaaccatgcgaatatctcccgtcttgcagcagccaatacaccaataattgcacctgctccagcccatacccacttaccaaaaattccagcaccaacaactttatgcttaatggtgatgaactcttcaatagtaggttcattcttagctaagctatcctccacattttttagtctattgcctatgtcattgattgaatcccgtaattctcccagagtttcctccagtttctcacggtcctgtctgtctctcgtctgattctcaaacagagtcttcaatcgttcctccagtctgactagaagcagttcgcccgattcattcataatattaccgtagttgtaaagttaagaaccccaatagggtcgtatcataagatgactcttagataatacttagtatgatgggatacatccagacatagtgtctggtatcaactgcgaggtaactatgtctattaaagatattttccaaagtggtaaggatgttgtgtgcaaaatgaaggggggattgttggtcgtgggaagttatggggaacgaatagtttctgctaataacatctcagagatccccccagaactactacctttcccaccaacagagttagaagacacattccttctggacttgtatacatggaccgggagccaggcagtaaatgaccaatcctggttcaattacttttcattaccagggataactaaatcacctggaggtacagcagcactaacaattgaagaaggaaatcttaagttccccattagaaccaggaatacccaggtaatgttcagtgttcgtatatcaggaattattgcaggtggtgcaggtacagcaagggaatggagaacacaaacaagacgaaccaatggaattacgatagtaggttcagatgctagtgttaaagtacagggtacagacattgctaacagagataacgtactggctacttacacacttggttcaactgaccctttcatggtagacggtattcagttaggtatgtttaatatctcaggacaagtaattaccctaacagcagtatcaattagggcaatgcaaacagtaaactctatataagaaatattattaatagataaaaacaaaccccgcctgagcggggttttatacctagataagtaatagcctggtagtacgtaggctactgttaaccaactctactgatctaaccgtaccagtattactcacttagacataacagctaatgcttcctgcatacgcttaatagtacgccgcatcaacgcagcctctaatatcagtacttcctcgtaacgaataccgtagcgggaacctgctggtgtaatcagtttacgagagccattggcatcttcctcgtatacatcatcccaactgtcgaagcacaggaagccatagcgatgtgcatctataccgtgacgttcgaatgcctccttagctcgctgagcgatgatgccgaagtgccatctagctgagtctgcacccttctcctcaattcggtccaagtactgaaattgcacaaagtcaacttcagaccaagcatccagtaaagcatctgagataataagaggctctgttttatccctagcatctgagataacagtgaatgctgattgagtaaaaccgccagaccatgctcgacttgcggaacctaatgcgtatgtatcagtactatctggggtcattgcattagaacctaactgcaaataacctgtgctactggtaggaagacgcacgttaccgttggtgagtgatactgtccgagaagtaccatcagaagtaaataggcgaacttgagaagaagtacccccacctacagctaatgacacagcaccatccccaagcattctgtacttatcagccgaggtaagaacgcctgacggaagtgacatggacttaatccgccattcgaacctaccggacatactgcctatgtactgtcctaatgcaggagcgtgcactacgttactattactagtgccgtcaatagtaactgcaccttcaatagtaccagtagcactgagaaggtcgtttctccttcccggatgctttacctctacgaagttacgggtagaacctgattcgaaagtaataacacctgtagcactgtagctaggaaatacagacgcatagttgttattagctgtatctataaagcgcgcaattgtagcagtttgagcttgccctaaagagttagtaccatcacatcctgacataagcacattgcttattacgttatcagagccttctactgtaacaccgtgagcctgactagcgtcagagattgagaaatctacaagcacatctgagattaagttggtactacctttgcctgcaacaaccgctgcatatttaggattattagccactaccccattgataaggttgttagagggagctattgacccttctgtaccgttgtaagttacatgctggcagtctgcccctataacattgctgactatgttataactggctgtacctttcagttctacagccccgaactgagggtagttcttagcaatgacgttatttatgagggagttaaccgaggaatcagcaagtatgcatccagccgccttattagtagcatagccggagtagctacctcgaatgcctttaatcataagcccatcagagggtgcatcattagggtatgtgattaaactgaaaccagcgcccttaacgtttgagaaattaacatcacttatagtaacatcactgccaccagcaagagatacctgctgcccttgagtggtatcggtcgccttattactttctaccgtaatattacttaagcgacctgagcgtagattgttaaatactaagtagttacctgtacttgaacggtgacttagtacaccactgcctctaccgtctaagttacagtaattactattaataccagaactagagaatacaccgtctgatgctacgacagctttttgagaatttagtgaagcagctatattctccgtactatctgttacaccatcccctttagcaccccagcctcgaacatcaccctcatcacgccatcttgccatctgcaattcagggtaactggacgcaccatccgggtctgaaatctggctgcgcagggctgcatcaccgacgctcagccactttcctgtaccaatatcaggaacagacccagcatctacaacctttggcagtgcgccatcccatcgatacaacccaccctggtattcaagacattcattctttactttaatctcataacccaaagagaaggacccagggactgttataaactctcctcgtgaaacagctagtgcacccaggtcaacattaccagtagagtgaactaacacaccggcagtattaaggcttacagcagtaacccctgaaccaaggtctgcaggtaatgagtaagctcgctgggtagtcttatcataaatgaccttgtattcccctaagtctacacctacagcaaagtaaacaacctcattctgcttaacaccaaacttacgggcaatggcttgtttgttggtaagaataccagtggagcctttaccaccttgtgagaacatttcgttcataagaacctctttgtttttctggttaatggcgtccttgccgaatatatccttatgtacacattggaagattatttaaatttttccaattgccgacgaagaaatgcacacttaagtacgggagatttctcataactaataccgtatccacccctccaccaacttaatggcaaaatggttttgtttattacttctgttcaagagcagaaagtctggcttcgattctttccagttttcttctctgataagcggcttcagcaaagaaaattccgtcaggccgaacaccccactcctcaccctcttcatgaataaccacctcggtgtatacaggttcttccgtagtagtgacattaccctcctcgtcagtgtgttcaacgatttcattgtgtgaaaataccgtatcggtcatccgtggatacttgtcatagcacagaacagcataacgacaattcgtactgttttcatccatcagaccatgtgcaatgaatacatcacgaatttgttgagcaataaccccgaagtgaatacgagcatcattgcctttcagttgaacagcatctaaccactggtacatgatgtagtgaacgtcaccccaggcatccaggaaagcatcatcaaaaactaccggctctgttttcttctctccgttagaagtaacaatagggttacttccgaggtatgcagtggtgaaacggttacttggtccaccaagcgcaatgacgttatcgttataaggcttaacatcagcaccctgaaacagatgttcatttccgttgtaaactatcctgcgagaagctgtgttgctcgcaccgtaaagcgtaatctgtgcaccagtagaagaactggttccgtctcccccgcaaaatatgatgcgctgccctgctgggttattagtcggtacagatttcccgataaacccatactcaccttccattaaaacttcagagcgaatgttactactggtgctggctctaagggtcacatgacctaaacccaaatctcctgtaaattccattggagcaggaacagtgcgaatcccatttgtatcaaaaaacacggggacagctctgtcaggtacagcaccatatctgaaatccctggaaacacgattgtctgaaccaatcttcattttgtagcaatacaaatctgatggatgaccatctgatttgaatgggtctttcgatgagttatctccatatgtccaggggttcagatggtcttccccaccgaacaagtaatagatataactatccttaacgaccactgagccaacaccaacgccagagttgacaatgccaccctgataaatctggtcagtgatatttacccattgagtattatccaggttccaggtgtctaggttcactcgcgtgtaaaacgttcgcgggtaagaactgaaatatcgctggtcgggtgcgtttgcttcccactcgttgtccgcacgttctgttccaaaaagaatgagttcgtttcctaccttagcgaatggcagggtggagtggtggacattattcgggaacctcaatgattgccaggatatacccaaatcgttactacgatgtagtgaactacccagacgatccgaccgagttccacgggttacaacataaagaacaccgtcaaaatatttaacacagggttctgccgcatctggctcatattcagcagggatacgtcgttttatataatgcccaggattgttaaatgcatccgggaaatacagcataccaacttcacgtggagcagcatcaccctggtgatatcccatcataaatgaatcattattgatggcggtaaaactgtgaacctcggtaaccatgggaatcagtccaaggttggttttacgccaaggtgactggtggaacgatgtccccatatgccagactttggtagagttattttggtcagattcctgttgatttggcgtggtgacagtaaatgtgttgcggtcaataactgaagttacagtcatattccccgaaacaccagtcaccccagagttcgagaagttaacaaaatctccggcaaacaatccatggtcaggaatagtaattacagccacaggctgattagcggcttttgtgataccacctgtcggatggtaattacgggacataggacggtcccatatctcacaggtcaccagtgcgttagatgctaaagtacgtgtctcaatcatcgcaaagagacgattacgcatcacccccatactcatacagtggtagttaactgtcgggtaatcaggatgtaggtcggttaaccattccggcgttgtccaggtctgtccgtcatcccctgaacgaacccaggatacatgcagcctgctgaccccatgtctatcactagccatgaacgggcagtaaataacatcatcgtaaacgaacgctttatcctgtggccacgcattgtaataaggggtgtccgttattttgaaaagctcgccctgaacaaattcttcagaggcataataaagcggctgaccaggaatacgctcataaacaaaacgagtgttgacgaatcgactaatatcaggcaaggatgtgaccttatatgtcttcccattgccattaatcttttgtccaactggtgtgtcgtttaatacgttcgttaatgctactgtatcatcatgcacagcgtcccctttaacaccccaaccacggacatctccctgattacgccatagggtattttggtcagtttcttttttggttagtaactcaacctgaatgttacctggagtatatgtaaggatattaccaactacgctggatatatacacattagttggtaattctggaataacgtaaatctgctgattatcgggattataaataacttttttgttatttaaggattgtactgtattagtactgagaataacctcagaatcttttacattagccgcacgagccacttcctgtagagtacgatctgttgcttccaatactcgtgcttcaccaccaatctgtactatcaaacgatcattggttgtcagtggttcggtaagaaaaatacgttggttatctgggtcagcagtataagactcagtagttaatcctttatacaaacgaagaccattcttatacacagccggaatagactggaaggtatacggaatagcaataacctgctcaccccctacagcagcaccattgttgtacaaccaattgatctgaatccagtcattaatgttaggattatccggtacagcaggaacaccagtcagaaggaatactacttcatctccttcctctaaaggttgagccagagttacggacaggctgtctacgttgaactcaaatccacgacctacatactgcatgtcgccattaacaataatgaaaggtacacccaccgtaccatctggtacgttgattgtggtttccccaccagtagcagaaccattactgtatacccaaggaatataagcaccttcactggaagaagtaccaccaccattggaaccagaagtagcaacagtaatccacgaaccagttgcttctgagtcatctgggatgatgccagtacgatcaccttctacgtacaagtaatcagttacctgccggtcacctgcacgggagaaaccgtagatacgggaatatttaacctgcgtggataatgccttcaattcctcttcagagtttacaccgatgaccatcccatactggttcaggaaatcatacaggagtttaagattacccaggttgcagtacacagtacgaaccacatggtaagcattaccaagcagtgcatccaccatttggtcattggaactgctatgacaatatggattggtccaatcctgatttgcatcaaagggggtatgtgcgttcatcgccatcctcgttgttcaaatttagtttcggtaattgaaatacttccattagccaggtcgtaatcaacaacctcaccacagatgctttcatatgtttgcagatgctctgctgctttagcgttagcttccggagtattcaaaccggtgtggtaacgataacccacccagttatgaagtgccgtcattagcgtatcagctaaatcaacttcctgttcttcatcacccgtaagcactgggtgcttggcttgatacattacgttaagtgcctcaaagtgtcgaggacgcatacactgaatagtatcaggccgtggagtgaagatagcacgagggtccgaatcatcgttcagtctacgtcggttccctgagttatcaaatacatttaagattttaataacatcatcctggaaaggtttcatgaacccatccatgatgtatggatactgaacctcaagagtgggcttagtaaatctggagtaagcatatctggattgaagaggataatcggtacgcccttctttcatctccacaatacaactattagttctgagagggaaacgactatgcagtcgaaccaatccttcattaatagctgccagtatctcaggcttactatcaggctcaatacacaatctgtcatccgtgactgcaccagtacccttcaaggtacttagtgccaagccacggtatacttccgataatttttgcatggttcctcacacaatatatgaacgtagggggttaacactatcttcttcttcatcgtcccacatcgggtcacccttgttatccaccatagtcatacctgcctgtggtttccagggattgagataacccagcatagagatagtatcaatacagtcatccttacctttgattccattaatggtagctaatttaatctggcccatgaacaaacccataatagttgaatctctcaactcttccgggaagtacatcttaccagctttgaaccatggaactacctggttaaagcgtgacagcttagaggttacaggacgtatgcctggcttaccaccttcagaggatgcaaagttaaagaagacattacggttaatcatttctttttgaaggagtgagatgaatccaccttgttgacctgtggtttcgaccccaacattttgtggttggtattcctgaaccagacggaataagtcatcaaagtttttatccataagctgacgattagccacaccatcaacccagaaccaatctccattagaactataagcccaaactgaaatgacactgtagtcactggtctgtttctccgaagtagcaaagtcagttgtaatgtaatagttgtagcaggacttcatccttaatagttgttgtctgctataccacctaatttcactatcctgaaccagtctctcatcttcagaactaatacgaagcataagttcctgatagaagccagccaacttaccagtcttaactgccatatcgtattgagctttgatgtagtcatatgagaaacggtcatcccatgcaccctgaaattcttccctgctacaggggaacttctcgcatacaggccatacgttgacatcccatgcaccagactcaactgcttcaatgataatgtcttccttattaaagggagtaccattgaaaattactttacgacgggttgggtcaagagcatggttcacacctttatagacggtatccttaatagcttccatgcttgtcttggagttagcatcaccatcgctaatcaagtcatccagtacacagagtgttggacgtttaccatatatcttcgtaccacgaagacctgtcttagcaccaaacaacttaacaccaagtcgatgtccttctacattacggaactccagaaggttatctgtaaatgtagcctcaggtatccattgctgaaggaactcactattcttgtaacggaactcaatgttcttacgtgcagacttagcaccgttatccattgagtcagatacgtaaatcattccttctaccttacccaggcttggtaaatgaccaaacactgccaggaacaaagtaaagtactccatgaatacagcagttttacctgcaccacggaaacacaggttaactacatactggttcggactaatcatcttatccagcatcttcaagtgaactggaggtgttttgttagattcaccctccttaccattaaccaacttaataaagttggcaaaggtaagagcaaactgactaggaacatagttagaagaattaaggtgggagtaatccacctggtctagccattcatctagttcctgtttaattaattcagacatttgtaatgtcctcatctgcacgtactagtttagaaccagcaacctctttggtaggtacaccactattgattgcattgatttgctgttcagctaatgcagcaagtgttgccttgaggtcagttaacccggagttctctcttaagtccagattgatattcgttacctggtctttcggtttagccaagtgagtaaggatagagttagctgcatcacatcttactttctcacttgctgctgtggtcattagttcaacctgaacgttgatagccttttgataattgtcctggttcacaatccacactggaaccaaactttgttccatgatgaggttaaccaatttacccctatggtaagcagatacataagcactgatatctttctcactggttcctcgtgctacaagttctgcttgtcggttagggaatgtcttaaagtaggcttccttatttgagtagcccatgtgtttgtaagtcacatactgaactgcattcatgtagtcctgtgtcttaaacttaccttccttcataactccagagtaagagatgaagttttcacggaatgcttcagcaaccagttggtcttgggtaatgttgttaattgtgtccaccaactcctgggttacactgttcttgaagttagcaggtagggcattaacaatctgctgcttagttagttcactcatacttatctcgctacaaagttatgtctattaaagaagattcttttcttggggtgagttaccccttgaagaaaccataccatacagttacactttagtcatgatatagaaaaagttcatgatactaaatagtatgtaatgttccgatgaccctattcctaaaaggagtaacatttgagaatctatatgagagtccacgactccaaagatgaatacaaagaactagaccataccaaggctggtattctttcagatgatattatcattacacatgatgaagattcctaccatgaattagctgggatgatgctattagagaatcgtccaggcattaagatcttagaaccaagagaaacttactctttagaaaagagactttcagctcttgtgttcttcacaaaattacctcatagtgtctccgtcaggcgaagcaaagatagtgttcggatgatggtgacgatgtgattagtcatgccgcctagtagacagtggcggtactcgtaaagagttaataacttctacagtcagggttacccggctcctttcctacctagtaggctaacgatacacatgtatctagggtgatgaactgacccgtgattgaaaacggtaaggggtagagtcgagaggctctaccccatttctttttcaggaggtatgcaaatatgagcatctacgcttttgatattgatattactgggatacttcgtaatcaagaaccttattaccttggggaaccagaagtagtaagtaagttcattaccccatggcaaacagtattcttacctgactgtgaagagtcacacgaggttattggttctcttttcctatccaacctgcaactcaatactaagatactcactgaaccaaaggtgtatgacctctccttttacagcgactttagtatgattttccctggtgttaggttctataaaatacctggttgggaattgatagctgaccataatgtctttaataaaacactttccatttacttcagacctattcctaaaggaaggaaaattaatcatgaaattcataatgaccatccccagttttgctgaaagagaatctatgtatacaactgacttctctttagaagaagtaatgaacagcaacccccagcaagtaatcctggttcctaccttagaggactaccatgaagtaaggggacagctattcttagcaggtaatgatcgtaaggttgtatgtattattccaccctctgtctataccaactacagtgcaggtgaccctatcccatatatgttggtatctaatgactaccaatgggatagtcggtatgtaaatgatgaatactgttactactatataaggaagtaagatatgcatctgtattgccttattagctttgctactacttgctatttgtctccatatacattggataatatcctggcaggtaaggggagagttaccaccatcctgtatgagccaagtgaagatgcagatgtgctcataggtacttgcttaatgttggggcaacctatccaattcattaagatagtagattccgtagaaataccggaacacaccagtgtgtacatattgtcagagagtgaacctatggtagtaactacccttactggtagacttattaccctctatccttctacctcatatttatctagcgacgagagtctctaatgaaactaaacacatcaccctacccggtacagttagaagtagtattcgaccaggataccttcattaaaaagtataagaaacttaaagggcatgagccagacttggatggttgtaaggggtatacttcttattctggcaatcgagtattgattggtatctttagggaacctttacatacactcatccacgaactcaaccatttctgtttgtgggcgtttgactacataggtatgcctataaactctgccaatagtgaagcatattgctattactatgaccacatcctctcccagattccttcctcctatttaactgcttataaggattagcatgagattatatttcctatcagatatgggaaggttacatgtaggagagggtatactatggaattggatatgtaacaatattcccaatgtacctgtatatgttcactccgatatagactatcactggttaagaggcgagtgcttacttagaaatatgatagttaacttcataaaactagaaccatgggatagggtatccgatgtatctggcccatgctacttcttagcagttaatgggcatagagcagagaagatgttatatagaactaaatagagggtagatagataccttctcataatatttataaataaggcagaaccggtgacaagagtacaatacctatgaatcctatagcgaaggcacaggcaataaagtgaagccagttctcagggtctgtaggattgtaattaccccaaccatctttcatgttagtaccccaaagttatctgcttatagagatagtgcctataatatttttgcatgtcaaaattgtgatagctatatacagcagcagtgttg

SEQ ID NO: 27 - DNA, 356230 bp, Unknown
  Giant Phage
aaagtatataaaaatatttcaatgtacttaaatgaagattaccacttccaacaaacaacgattgaagatgttctattcagtactgaagaattgaaagaactatattattggtataagaaatttacaacttgacattatcgtggatttatcctacactgtaagataatgatgaatagaggataaatttatgagtttagatttacacaatgaactaaaatattatttcgatttggatatatcacatttgaaccaacacgtcaattatatgactagtactatttggtggtctgatgagtttgatgaaccaaaaatccaactttgtggtgatttgtccgttttgaggttgtatgcccttgattcggaaatgaatatcaagatcacatacataccatacacaaacaaacttattgtaaacaccctaaacccagttacagtattgaaaatttctgatttggacacgatacagtcagatgaatcactattccaacgttctttgattgatgatatgggtggtattttatatgaagatattgtacaattgaagaagatgtatagtgaattgttagaaattaaaaacacagtaattgtggggagttgatatggtaagtttacttgatattgataataccagtctagtactggcaaaaaaaggtgtaattcccaattctacaaaaattgattatgcagttattgaaacaaatattggaaatatctggtatgactccgaaagggatattgtgattagctgcgtagacagtgaccgtgctgagtgttgtagggttggtcatgacgggcaatttattttcgaattccgttactggaaagatgctaaattccatcatgagcatgtttcaattacaggtgtgtattgcaccgaagaatcgttcttcatggatagtactgttaatgattttggttcagttacatttgagtactataaaaaagtatacaacatatccagagaagtaatgcgaatcatcagaaatgctgagggtcaagattaacatgactactatatatgacattctaggtgacttgaataaaaatatagataatgattttgttattgttggaactacacaaaatataattcatcttccattgggtacaccagataggttaatttttaatatatacggaaaaacactgacatacctacacgatggtatggttatattggtacttgatattaaagaaaatacaatacgatatgcatatgacttcaacgattattggtcaagaacccatagtattgatattgaggaagatgaactatttcaattgtcgttaatcgagaaaaatgtattaggagttaccgaaattggcattgttaaaaaagcattagaatatgtaaatagcaaattaaatggtgagctatgatgaaaattgatgaaataaaaaatcattttgaaattgcattgtcttgtaaatttgatggctcttatgttcctgatccagaagagataattagaatttccacatcgttttcggaagagtacaatgttcttattgagaaaacatatgacagtactgaactcgcattttacaataagaattcacgaacaacaacatttatattattatataacacaacatcggatataatagaaattataacatgtaaaacaagcaaagatatacattatgagactatctcaaatgtgagttattgctcaactgaagaaggatactttcaggaatctcttgttaaaaatttaacagttagttattctgatttaagcactataatcaattgtgttgaaaagctaaatgatttcgttctatctatgtttgatatcacagagcaaaacccgaaggtaatcaaatgctaaatccaggacagtttttccatttacttagtattacacctataccggatttagttagtgagacgaatcaatatcgtgatataggaattgtatctatggaatacgattcacctgactttaaatgttacgttacatatgatttggtagcctatgagtcagaaactgagataaaaaaaccatcatacatttttgtgttcatatataatgattatagtggtgatctactcaatgatgttcatattgacacatttgaaatatgtgataatattatatcagatgattcatcatgtacatttgatttgtcagaaaacagtactgaagaggcactttttcagttgagtactgttagtgacactgtactaactcttgatgacattgagaaatttaaagaacagcttgacgcagtacgtgagatgttctataatcattatccagaaatcgagttcaattaactaaaggtatcaaaatgactaaagtagttcgtaaacgccacatgatgaacatggatgaatttcgcacctttgacaaataccgtactatgtttcgtatgctgtcacagggccgtccaatcgtcattgtaacggagaattacatgtcacctgagatgatgttcggtaattatgaaaaggtcttcatgttgtacgtgaagcgtgaattgctaacgattaagaccttagctgaagctacagatgaagatatggatggtgataatacatttaccatgtgaggaaatatatggcagaaaaaccaaaagaaccattggaccgtgatgatgatttttacgacgaacgatatggggaatcagatgagtgaacatcgtgcagtacttaaaaagattttaaatgaacttggtgatgagtttaatgttactgaagaagaatatcaatgttggaagaaggattttgaactccttgctgagtatgataaagtcttcaatatgattggtgtcattagccagtacttacttggtggtggtcgagccagtgcttcaattcttgcatctgcgatcatctgtacttctcgatggtgcgatgaaaaaagtctggaagatttctaaataagatgctataatgtattatagtaccttaacaatataaaaaggattttatatgaaacctatcagagtactgtcactttttaatggaatgagcgttggatatatggcattggcagatgcaggtattccagttgaaaaatattactcatctgaaattgacaagtacgcaattgctgaatcttccgagaattttcctgatattatccagttaggtgatgtgactaagtggagagaatgggatattgagtgggataagatagatttactcatgggaggattcccatgtcaagcctggtctgttgctggtaagcaaggtggcttgaatgatatacgtggacagttatttttggttatggttgatatttttgagcacatcaaaagtgtaaatccaaacttgcaatttctgttcgagaatgttaaaatgaaggaagatttcaaagaatacattaatagtattttaggaatcacaccagtactgataaattcccagcattatacgcctcacttcaggcagagatactactggtgcagtactgataagctttttataccacctgcattatcaaatgcccctaaacttcaagatatcattgaagatggttggtacactgacagaaccgcttcgtactgtatagatgctaactattttaagggtggtgattgtaaccagtactttaataaatcaagacgacagttggtgtttcgtgacccaacgattaatcgtcaatatctattggagaatggtaaaagaaatattgactatagacacttaagtgtagtagaatgttgtaaattacagggtattcctgtagatttctttaaagtgtctagtaagacacaagcatacaaaatgcttggaaatggatggactatgccagttatatcacacttactaagagagatattcttttgaacatgaagaactaccccacctatactgaacgtgtaatgaaatttcaacgtcagtcatcaaaggaagaattagaatttaatttgtactatcctaatattggtgatgaggtattctattgttctcatacaaagaatggaactttacttaaatccggtaaaggtattattgttgatatgattagcactttcaaaggtaaacttaatgtaatgtacaaagtacaagattcaagtactgagtgcattcatgaagtgatgcataatatacctgcatatccaaaggattttgttcagctaatatctcgaagggagaaacctatgttttattgtggttatgacaaactaaccaaacaaattattcctaatactatgggaaaatttaaaagtgatgttaaaactgaacttaataagaaattaggttcatcatgggaaactgaaaacgaattcatcgaaattcgtttgattgaagttactatactcgattaattacagatccacgctatgcgtggatttttcataggtgcatatgtgatagttccttatgttaaaattattaataatatccttgattcgtgggaagatgttattactggtaaaaagaacccaatgccagtacacgcactaaccggaagactacaattcagaacgtcaaacaaaactgaaacttttaataatcatgatgttcacattactataaaatcacctgtacgtattgtaattaaaaaaaatcaagatgatgaattgacattatctattggtagtgataaaatcattttgagtaatttatccgaagaagaattctttcaacgtagtactatcatcgacatgaaagatttcacatatgaatcattggttgaactcaatgcacgtttcaacgatattcaggaacgattgcgaccaatcctccgcaaagaagaagaagcatggaatgaaagtgtaagaaagatgcaagaaatgttgaaagaaaatattaacaatctgggtaaagctacaatggaatttggtaaatcttttaaactgaacttttcaaaggatcgtaaatgaaaattgataatttgattcatgtcttagggactttacataaaatattattacatcttaacgagatgaataaactaggttataatgtccataatgtatttgaacctacatttaaatataactcaatcactggagatggtaattacataatcgaatatacatatgaaaccgatccagacttctatcctcttacgttgagaatttatccaacaaatccgataggaattcacgacatatcatcaatttcacttgatccagatggtgaaacgagtattgaatacaataatgattcaaaaccagaattttacattgatgacattaaaaagttgttcaatgatgaatatgttttccaacaaagtactgtgcatgatgttggtagtactactgggcaattttggaatacatgttattatcatatgattgaaatttgtaaattactaaaaggtgttgaataatgaaatactgcattgaagtacattacactacaggtgatactgaaaattgttatgacgttcttaatacaattgatattcaatggtcttctaaagaggaagcagttgctgctttacagtgcctaaaagagcattgggtgttttatatgaagcaagataattgctatacaaaagaacacgaaacgatcatggaaaatgctaaacaaaaagagtggtttgacccaatatcaccagaatattcattcttggttaaagttggcgatgtgactgttccattacgaacaccgtggaacggctactttgaaactcttcataatgcacgagttgtcgctgttgataaccctgaacaaatcgatttcgattcattggactggaaaaaactatgacagtactgcaccgattgaagaaggttaagcatccagttgtatatgaggactggaaacgacagaagttgctgggtgatttttattacccaaaatctaaagttcttgcgaattcaagatgtacatattgcacacataatgataaagatacagtatttgtcgaaatgggtttccatccatcaaacacaatgttcactactaaccaaacgttttacaaatttcatatacaaaaagattcatttactgttatgattataaaacatttagttgaagatctggcattcagtgaagaacgagtacctttatcattagtggatattccttataataatttagaggaaatgtacttccaacagttgacagtacaagaaaactttggtatgataggacttcaagagttagagatgattaagcaaattcgtgatatctactttaaggagtaactatgccagtacgtaacagtacttcacgctttacgcttcaacagaaagcagatcttttgaatatggcaaacaaagattctaattattactatctagtactcggtggttcagttgaaaagattgacctacgtgagtgtatgaaataacacaaaggggactaaaatgagtctacgtgaatcatgggaacaatttaaagaagagattggttatcgtggtgtcaaaatcgaaccaatcaatcgcaccgaaagcatcaaagctagtactaatggtactacctatgatcgttatgatgaaaagtatggtttacattctaaaccaaaggatactgagtaatggtgtatactaatatttttactggtattatgcgtaagtttgttaatggtactggatatgtatccaatgacaacggtagtacatgggtaaaaaataatacatccgaatctttagtgaaaagtcttccgtattataaagcttgacacatgaaaatggagtatgtataatactcctatattaatcaaatgaggatatacgaaatggctggtgttgataaaatttgtgaattcagtggcgattatgaaggttacgaaatgtacaagtccaagcgtaatcacattcaagttctgtcaaagtaccgtaaagaattccgaggacacaaagcaacattgtatgtttttgagaatggatattctgaagttttcacaagtggtgggtatagtacagctaacatggcacatatcaacccaaacccaactgaagatgattggaatagtggtaacgcttttcgtatttcaattttgaataaaatgaatcgttacgaccgttattgtacattctttgaaaatatttcagaatacaagcaagcattaaagaaatataatcaacgcttactaatgaattatgattacattcttcatgttcctactgtaccaggtcaggttaatggtctgtatacgaacagtacacatgatttaactgcggtgaagcgtcgcctcaaacgtatgttgggttgtggtaatttaacaatcaaggttatgcgtaatgaatcaatgtataactttttaaatgtactacactacacattgaaggataataatggaaacgattaagtttatgtttgaggtgtttgttgcattcatcttatgtgctgtatctattgctattgctttaatcccagtaatcgtttaccaagttaatggtggtacagacccaacagttgatctgtttcttcgttgcgtgggattctgcatatggttggcgatgtttatgtactatatgcatcgtgaggattgattatgtcattggaaaaagtaattatttctgaattccgaaagtacatcattgattgtgatagagatacccagcgtaagttcaatgagtatcttgacaaatatccatatttgatgtttaatccatttgaaactcaatccgatgttaatcttggattttacattgggtttacacaacgaattctacaacaatatgagatgaaacagccagaggtttgggtagaaactgattcgaatgagacgaatgttttttatctgtactcttattatgcggaaattgttagttcaatgacgctagaagggtatctattcgtcaaaacatctgatattgaaaaaatatacatagaacctgtatctttggatatggttgcccagcttccaacagttcaatatttggatgcaaatgagttgacatattcggtgtttgagtaccttaaccgagacgatttaactcaagaaattgagaatatggtttcaaaatataccacaactcttatatctaatggttcacttagaatagaactgatttacgacgatactagtactaatgcagtacgaggaactcgaattggaaaagttactatacgtgttgtccacaatgatgtagtacttggttatatttcgaaacgtggtcatgacttgtgtttgattaacacatatgttattgaacgaaaagaatggaacgatttaatgcaaaaaatcgtagacggaagtggaattcgtgatataatgtgtaatgaggtagtgacaatgaatcctgacattgactgtgatgtatatttcccagttcctggatttactctacgtaattttggtacattaaagggtacaaaatgaaaattttagaagtcttacttgaaaaggatgcatccggcactctttatgttggtaatgagttcagtcctgatccaattgatatgatgcagcgtattcaaacactgacccaatcaatttcagttaaacaacctttcctaaaagaattggaaattcactgcgataaagatatggaacaacatgataatgttatttctgatatcaaaagtctattgacaaagaatggatatgtggagtataatccttctatcgtaatcgttatccctgactttatgaaaggaacattgtaatgactaaagaagaaatgaaatctcgcctaagcgaacttaagaaagaacgaaaactagtccgtttggactgggacattcttaacaaaaaagatgagcaatcatatgctaactggagttccgataaagttcgcaatgaccgttccaaagaagacgctaaacagtttatggcattgaccaaacgtttatcttcactgaatagtgaaattacaggtcttcaaaaggaaattatttcaattcttcaagtggagatcaactcactgtatgaataaacatgaagtgattcattttgatggtaagatttatgtaccaaacaatgatagtactgaatcttattatctaatcaatgcaattatgtcagaaacacaaacatgttgccgtcagcgtccaggtgagtatgagttcagtcagaccattggttattatcgttatactgaacttgataaatttacaatcgattctaaaaaagttattgacgttctcacgaagaacggatataatgaatccgaatcaaacgaaacagagttaccagttgtgaaatttgttctaaaaaataattaatttttgggacaacactgaaaagcatgatataatgtatattatcggcagatgtaaaaatgcaaaccattcctcaatgatgagggtttttcataaaaaagaaataaaagggtattaaaaatggctaaagaaactaacgcacaagtactagatatcaccgacttcgaccgcactgtgaactacattcagttccagattcatcaagctgaagaagctctcgcagtattccacggtactggtgcaaggccaatccgttttgctcatctaattgcatggaagaaaagtctacaagaagaactttctgaactgcgtaaagcaaaccgtaagtaattgatttcctgcctcatcaatgttgatggggctttttaataaaatacaaactgaggatatattaatgagtgttgaatattggtttttgtttatatgtcttggtacactagtactgattacattgggcttaatcttcaatacagtaatcagtggtagtaattacttcaagtcatttcaacttctaatgtcagcaatgcagtacagtgacgaggcagaagaaaccactacgttgattttgaataaacttgaagctaacttactggttgctaaaatttcttcgtgtaatacaaatattgtattttatgcatcaccagtggatcttgatggggccgaaatgagtaaccagccagccgttgctgaaatttttattggttctaagtattatgcatatggatatatccgaaagtattatactgaagcaaaagccgagctaacaaagaaacgaccgtcaattaagacattaaagcgtatcatcgcactagaaaagaaattacgaggtgatgtgacaaaaaatgattcacccactgtagtaaatacaaagaaaaaaaataacgtagtggagttggattaatggacgcagataaatcaaacagtattcttattgatgtacaaacgaagttattagatgttatggaaatcatcaaagatttaccacaaggatatcagtttaaagttcgtgaaatgttatcttgtgcagaaactgttgtgtctatgtacaatgatgtgcagcatggaattatccctgaaattcttcaagatggtctaaatattaacacaaagattccagtacaagagcctgaagaggttgttcagcctgaaccagaacctactatacgtaaagtactggatctatctggtatcaaaattaacatctaaaatacattcaataggagaagtaatgagtaatcaaaaaattgacttagtagtaaaacttcaagagattcaagaactagcgaaatcccttgatgaaaaacgtgcagcagcagttgattcactgtgtgcaacaattctgactgtttttgcagattacgaaaagaaatctgattaaacattactttatacccagtctagtactgggtatttttttaaggaaataaaatgactgaatctgaactacgtgaaatgatagatttcatttatgaaatggtacaagataaaaataacatcaatacaattgcatctggtccaagacaaattggtaaccaaataacatattctttgtccttatggttacacccgtgcattaaggttgattgtttgtatttccgtcctgatattgatgcttattattttgtcaatcatgatgcattaatgaaaccacataatcgtccagttgatgataactttgtgacgcacccattttacctggctgattccgaagaggatgagtttcaaaagaacacaacgttaagcccaggtgaaatttgcatcccttatgaactaaaagataaaatgatttacatcacagaagttatgaaaacatgctggtaagtgcaatgaaactctgatataatactatgacttactaaggagaacatatgaactttattaaattcaactcatctgagtcagaagcatactttaatacaaataataaatttaatattattcttaaagacggaacggttgttatcggagtatcattgctttcatttgatggcgaaaaactcaaaactgtttataaattcaccaatcttgatggtgattactggggtacgtcagatgtatctaaaatttgcacacattatgtatttgaatctattgaagttggtgatggctgggcattgacctgtaatggtaataaagtattttctggtaacatatttggagtaatttccagtaaagaaatcgtagaccatcatcttcatgttctcaataataacgccaacacttatacacctgataatatcaaaattcacgatattgtaacatacactgattataatggtttcagacataaagcaatcgtaactgaagttaaaaaaccaaaaaattatttcgaccacggtttaattgaagtatatatggtaggtggcgaaaaacaatactttgatcatttcacttatactggttggaatagattcctaaccgttattgaggaatactaacatgccaattcgtggtgtaccagaaccattaattgaagttattaagcatgttcgcattggagatcgagaagttaatcttcgccgtaataacattttttactttaaaacttcagaaatgagttctgtacagattgtcattggtacatctattaagatcactcgcgtacttgatggtagtactgacttcgttgaatataatgtacttactaataaagtaacgcatatatataaatggagtgggtataaaactattaagtatgaatttgacttagctagaactgaagaagaacgatttatgctgagtactatcaatccagcaaactatcctgaccttgatgcatttttgctaattttaaaattgtataatgaagcaaatcagaaagccaaagattatgatagaatcatgtatgaacgccgaaaagaacgtgcacaaaaaagttatgatctgtatgatagcccatacgtgaaatatagtaaggggtcgaaatgaataacgaggttcaaattgtcattactccacctatacaaagtctggatgtatccattagtgattttttggaaaaatactatgaatggtttaatgaagattcagtaatttataaccattcattgcctgatggtttcgttgagcttattgaattaaatgccaaatcactatacttctgtgttgaatacaatgattatatgacagatgaagcatatcgttttcgttgtacattgtatcctaaccatttttccattggttataaagactatcagtactgcaccacaaactatagtgtagaggaagaatttcagtacaatttactttatcctgatttagattatacgattgcagtactgttgactaaaatcatggatttttataaagataaatataatgcagcctaagacatttgatgagtggtttaatctacactataatataaatgcagcagatatatactattttaagcttgaattgtatatatcattgcgtaacccaatcgagtactataacaacattatcaattgtgatgattttggtacatattttagtatagcagttatggataaaataagatgacacataaagaatggttggatgatctaaaattcaaacatgatcattttggcgttggtgtacgccaaggtcattatgatgtgttaaaagataaacaacttttcaaatcatttgtacttgatgaggatagtaatcactggttcatctatgagcttgcggttagagacaaaaaaattgactagtactgatatatatgctattcttttgttttaaacaggagaacaataatgctcattacgcatgtaccggaaagtattactgagattttaagtaaaattaatgttaatgaatttgaacgaacagttcgaaaacaaggtacttatcactataagcacaaagatggtgaacatcaaataagcttagatcagaattatcaaactctaacaattaaaatggttactcgctggaattttattcgtaaagatactattatctgtgattttggtaaaagactacttagaaaatgtttctctgaaacaaatggtatctatccaaacccgaatagaattttcacatatcaatacatcacagatgaagatgtacattttcaagagagtttggtatgtgataataagtactttcccgcattttcagataatttgaagttaaaagaactatataactatttcttaaacgacaatattctgtgggatgaagaattaaaacaacgacagatagaacgtgaaaagaaaaaagtctggactggttcacattggatgcaacgtaaatgacacatgaagaatggatgtctattatgaaagaacgatatgatctgtttgggaatggatttcgtgatggtcattacgatattttacgagacaaacatcagttcgatttatatgtactagatgaggatggaaatcgatggttcatatatgagcttgcatttagggattagaagatatattatgagagtaattattaatccagctaaaagttttatgacatcagtttacggtgctgatgatattatccgaatgttaccacgtattgaaattgatggaattgaagtgagaaaatacggtaatatatattatgtagtagattccaatggtaacaggatcagtgatagcttattcttcagtactaaagaaatggaacacctaattgtaattgattaacaaaaagcggcatcgcaaggtgcgaggtgaaacttccgatttccaccgctggtcgattcgatttcgacatgccgctcaaaatttacattgacaacttcagtatttttttgctataatcacttcagataaataaacctacgaggaatccaaagtgactaaagcagaacttgtagcattattggaatcatatcccgatgatgcatgtattgaagttgttcatagtgcgagacattttgacattgaagatgtagtacgttataatgataaaggtgtactcatcatggaactatgtattggtgaaatgaaaactgtacccgaatcagaaaaacgtaaaaatagtaaaccgtaaggaaaataaaatggaatctactctattagaagttattaactcattaaacgctggcgacaacgtacaagtactccttcagggataccgtgtaaaaggttcagtagttttagttaatgacaccactgttgttgtaactgaaactaacccgtttgacagtaatgaacttgctaatatccatattgatattaaaagtattattggtgttggtgtaactaaaccacaagaataacaattgttattggggattactatgcattttgaaaaattcaatacaaatcgtaacacacgcattgacgttctttatgaaacacaagactcaataagcattcgtacacgtagtggtgatgtatatcatgactgtactattggttgggaacagggaagaacacgtagtgcagaattcgataactattgcttctaccaaggggacaccacaatctggcctgaagacgtagcagatattgcgattgaagatgaacataaagatgaatttataaaatttaatcccgaaaccgaatcataaatattggaacagactataaagatgtgatataattattagtactggtgaagtggcagagtggtttaatgcaacggtcttgaaaaccgtcgagggtgaaagtcctccgtgagttcaaatctcaccttcaccgccaaaatccgggcgtatctcaacggtcttctaaaccgtcgttaatcgagtaactggagtatgcaggttcgagtcctgtcgcctgggccaattttaattaaaggttaaaccatgacgcatgaagaatggatgaatgacattaattttagatattcgggtatcggtagttggcgaaaatatcattgggaaatcatatcagacccagcagaatacgataaacttataaatgatgaagtgtatccgtggttctttattgaaataatggtacgattatgacacatgaagaatggatgaatgacattaattttagatattcgggtatcggtaaatggctaaagtatcattgggaattcatttcagagccacatctgtatgataaacttatcaacgatccagcatatgaaatgtacttaattgaactactggtacgaatatgacacatgaagagtggatgaaacgccaaaaaataaagtggaatccttattatctaccattagattctagaatgtgggatgttatacgtgttaagtgtatgtacaaagcatatttaagtactgaactcgacgaagaagtactgatgcatatcgtgcaccgatgatgaaaaagcttgactaaatagttcagtactgtataatgtttgtatcttaacttatatggcaacttgatatgtttagtgaatatgaagaagcaataaaacacaacattgaagattcacataacttccaattttataattgggatgaactaatgaaattgtacttacagtgggttgaagatgaagaaacttctgaacaacgaactgttatgttaaacatttcgttacgtaaagaccttagttcaattagtgttgaagttatgacatcttcaacttatgcagaagaagatcataatccctatgtttcaggtacttcccctgtaccaaagactgaagaagaatattttcaaacgagtactgtacaagaaccattattcacttatgagttctataagtacttgattggtgaattcaaaaaaatgcgaattaattcttgactaaatagttcagtactgatataatgaattccacaatcagacgtatatggtgtaagttacgtcgatgcaatccagaacaagatctctggtactctaggaagtggtgaatgttaacctagacgggtttgataattggacgataggcaattattacttgactagcaggttgaaactagaggtgacagtccttcaccaaactggaaaaccggatggacttttatttaaaagggtaaggcgtggaaatatgtttacagaagttgcttttagtagcctgtaagtcccacgtcaaggtagccgaaaggtaagttaaaacgggtggttataaagctgaattaacagcagcgtttaaaagcgtcaccatccatttttttttaattaaagttggtgatatgagtgttaaagacatttcaaagtatgaagagtttcttaaatcatttttgaattcagaattaacgacagaccataccaataactggtgtcaagataatcctggaattcgcattttcaatggatatggcgaatcatttcttataaatgacgatgaaattgtttttgaatcatttgaagaaataaaaaggacaaataacactttacgtgatataataaatagtataaatgctcaatacattatcttccagctaagtgctgatgaagaagatgaatttcagaaacgcacagtatatgaaaatgtgtttccacatgaattaaattctgtaatatttgaagtgttggataaggttttttctgaaaatagtacttgactaaatagttcagtactgataaaataaacaaatacggaagggtggcagagcggttgattgcactcgcctactaagcgagcaagtgttagaaataacgcttcgtgggttcaaatcccacctctttcgcaaatttcggtcccgttgcctagcgtccgaaggcagccgactcataatcggtcacagttaatgacacaccactggttagaatccagtcgggaccaccaataagactctgtagttcagcaggtagaacggttgactgttaatcaatatgtcgggggttcaaatccctccagagtcgcataaacaatgagaggtataaatggcatatttcttgattcaaagcgatgctgatgatgaattaatcgctaaaactaaaattgatattgatgattaccgaacagtactggaagctatccattactatgatgttcgacacaaaggtaatcgtgaacaaattaagaactggattgaatcgggtgagtacaaggttgaatctttatctatttcaggtgatgaaatggaagaagatggtttctttacagaaacaatgtacttaactattgaaaataatttctaggaatttaaatgaaagccaaagacctgattaaaattttacagaataatccagaagcagatattcttattcatgttacaccttgtgatgactctgctattagtaactgcctatctgctcattcatatcaagcaggggacaccgatattgaagaggatggtgaagattggtcggattcatttgatgaagatggaaaactattagtaccagtcatcatcctctcataaaagaacgaaatgtagacggttgtattcagtactgaatcaccaggggaggttgtgattcccgattcagtagttttaaagctgacccgtatgtgcctacacattacaactagtgcacatttaaaacctagacgtaggatgtaagtattcagtactgaatagctgaaggacttattatggtacaatacagtgagaggtacttcgagtatactcagttcacctttagctaaaatggtcactgtagaatattgttgcaacagtattcagtactactttttaattgacataacatcatttgggtgtataatgaagcgtaaacagaatcttagtaagaaactacaaccgacaatgacgaaagaacagttgtcaacatttatcaacgcagcattagataaaggtaagagtaaaaatgaaagtaagtgaagaaactgctaaacagcttgaagaactttgtagtgctgcacctatgccgacacttggcttaatcaagttgatgcgtcgaaataagcaaaattcaaaataataaataatacagtaagatggcctcccctcaatgcgaaagagtatggagacttgttggtcttcttactatctggttgattagttaaatggtataacacggaccttgtaagtctgagtcattagttcgattctaatattgaccacaaatatattcttagaaataacatttttcttgaaaataaatactccataatatatggagaactatatgaaagaaaaacgttattgtgcatgttgtaaaattgaattggttcgaaagggtcaaacaaaatattgtagtgttgcatgtcaacaagagctacaatatcaacagaaagttgataaatggcttaacggtgaacatccaggatataaaggtattactatacagttatgtccatttgtgagaagatatctacatgaaacacgcggaactgcatgtgaagagtgtggatgggataaacgtcatccaacagatggtgcagtactgacagaagttgagcacattgatggtgatgctacaaataatgacctaccaaatttaaaaatcctttgccctaattgtcattcgatgacaccaacattcagagcaaggaacaagaactccgcaaggaatcgtaaataattttttaaggtacaatatgacatacaacattgttaaaatggtgaactacgtattaaaaaacaacgcatggtcactgcatgatgtacaattagaagatattggtgaagttagagttttttgctatgatgacgatttgaacgaaaccactgatttgagtaaatgttttaatatttttcttggttatgaaatcaataatcatttttattcatttgatgtgtattttgaacgagttaaaatcagaattgctaatgtaaatagtgattattatgacactagaattgaattgaattttgacgatattgatactgaagaaaaattctttcagtactgtctcgtaaacgatctaaatggattgacatttgaggacattaatgctatacttaaagttcaaagattaattccagaagaggttctaaatccgtttaatgattagtttaataactcatataatgcaagatgttcgtaagaatctttatactggtaattttgatgatcctaacataaaaatattatgttatgatggattcacactggtacatccatcagaatctaataatatatacatagcatatacttctcctaatattttgtatcaatttgatttatatagtacaatggctaagataacattagatgtttctaaggagccaatttttatagcagtacgtgattttgagtacacagaagagtcattattccagtactcaatgataaatgacattggtgacttgacattagaagagataaatgttatagttggtatgtgtcgtttgattaatccataactcggagcttaatatgtttttgaatttgttatgcttatttggtcgtacattggttcttgctattattcatacacctggtattcgtaattatgtttcttatgaatttaagaaaaattaccacaacaatactgaagttcgtgcaactaagatgtgcaaagacttcaatggagatgttccaccattcaagaagtacgaggatgaataatggaatttattgttgcacctgatgaactaaaaacattcacgttccgagacaataacaattatccttatacaaatcattcattgaattcattgcatgttatatcaatcattgcatctgaatacagagacaatccatgtattgattttaaaaccactgatggtgaatatacatgggtagttccgaacgataaatacagttatcagggtgcagtggagatccgcgactcgattctaaagcaaatcgaagatggacatactcatcctaaactaaacattcagtactgaaatcgtttaaccggatagcttctagtcggtactgaattcctccttttgtctagaagctatcactcttttaaagtataatgatatcaccctcatggatcattatattcgttaccctctaacagtatcttttttattcctctttgatactgtattttagaagttgacatttttacttctactgtgttatacttaaggctgattcattatgaatcggccttttttcttgtggggattaatgtaatgaataaagaagttattagtttaattgatgagtatatcaaccaaacatatcgtttgatatttttaaatgaatttgagtccagaacaacgtattattctggtgaatatgagataatgactggatcatttcttaacggatacatggagtttttagaacaaagcgataatgttttcatttccatatctgaaaaacatggtgatgattatgttattgatgtatggcctaataaagtagagattgacactacaaagaaaattgtaattgatgtggatgaatcgttgtatgatttaactgaagatatgtacatgcaactaaatttcgtatacgacctaactaacataagttattctaatctaagtaaattattttatatttcaggtgtactacataaaaacgtacaacaaaataaaggataaacatttaaatgttgacaattgacaacataaatggtatctttgaaattgccagaaccctacgaggaagatgatatggtcaaaattttaagtgacaatgcggttgatattgtcattgatgtacttgaaaacagtaatacatttgagaagaaacacagtactgtatacttcggtaaagattgctggttgagctatatatctgataaatcgtttgtaattcgtgttgaaacgggtgatattggatttacgatacatgcggcacataccaaaactgataaacaaatcactgttattgctgacacgccaagtatctgggatagaattgatgattgtgaacactacacgtcaacattctatgatacagaagaagaacatttcatggatagtactgtcaaagaattagctattccatttaaacttatgaaagctgcaagagattttattttaaaatacaaaaaaacaggagttgatgatgcaatttaatggtaaggtttctaaagtaggtttagtttttgaaaattgtgagttcattgagattgatgtaaagaatgttttatggatgcatattgctgacgagaaaactctttgtagtcgtttttccaacggtctaactattcgtactggtattggtgagttcggtatcgcattacgtagtgatacaccatctgatttcatggataactcaacactgttagaacgtttaaaaatgcgtgatgttacacacgtttatctatatgatactaacggtgttgaacagcgttatgtagttgaatgggctaattataaccttagtgatcagtattcagtaaaccagcgtgtacaactcacccctggtggtaatattgtgtttgttagttcaactggtaaattaatcagtgtagatgatgcaaatattgatttattcacttcatataactaatacgaactactatgaaaacaatcaaaacacatttcaaagatacatggacagaagtaagtactggtaatattcaagatattgtatacagtactgaaactattcatgtctatgatgaagagacagcagccgagcagttaaaggtattgcatcgtagtgtaggtgaacacaccgagtatggtgtcaaacatactcgtgaattggtaagtactgatcatattgacacctgtactgtaaatctatcaaaagaagaaatgtttgattttattctaaacaatactttaacaattcaaccagatggatcactatacagtaaaacagatggtacacaagttcgtaaaaagtacaatgtgaccatcaatgatacggtgatgtctggatatgatttagttgatgcaatcaacgagtacgtttctatgcagaggttgaaatgattaatctgatatattttacaattatttgttgcattactattgtactttgtcgtctaattcatgtatactcatatcataaagcgttgagaatcgaacaagagatttacaacgaaaaccgtgagccagagccggagaagctaccccgctcaccatatgcattgaagcgtgagatgcattcggagagtaagaagtggggttatgcaataaccaagcatggttatatctacactgctgcaaatggctattttcaaattcaccatgatctttcagttgcgattggaattttatgggaaatggaggatataggtggttatgagcgtactaaatttccaaacttacaaaatgatccaggaacttcatgaagaacatgatataattgtagatgtagaaaagaaggaagttgttatgaagaagcaagcataccgcatcttagacaacttctatcttaaggcatttataatgaagttctgtgcagacgagcacttaacaggacgtgttatacgcaaggagtcgtagatggacatgagttcaacaattcagtacttgagcgagaattttgtcaaaatcatttcacgtggtggtatgattgtgcatcctgaaactgaagatatgtatatcattcgttttgatacaaattcttatgatcaagtacttgttgtttcgaaattggtaggttataatgaagtcgttcagttctgctgtaccgagttcggtatctatattaaagatgcagaaaccaatgagatttcacattatttttatcacacactgatgggtactaaagattttggattgaaattcaatgatttagtacaatgtcactatatgtttaaaacatacccagcatctgggaaataaggagtaacaatatgagcaacattttcttcaaaaccatttccttcaaaaaagaatcttactcttacgcttatgtagatggtaaagtactcaatatcgttctagatggtgttgatgttcctgttcaatttaccagtcatcaagaagcgattgagggtgctcaagagcttaacagcttactaaatggtattgagaagaaacctgaagttaaatctgaccttgatttattggttgacaaaattaaaagtggtgaactattatcaattctagaccagtgtaatgaaaaattacgtggtgttgttggtgatgtacgtactacagttcaagatcgtctacttgagcaagcattcaaagaagttactaagaaaactgaagaacgtgttgaaggtatgattaaaaacattgatgacgttctcactcatatgttcaccaagccatacgaatcaagtactgattctgaagagaaacaagaagaaccagtagaacgcaccaagccatctattgtttctaaagttaaacatagttttggctcactggatgatgtatttggctttacaaatgtacgtgttagtactgatgaaaaaccagaagttgatgaaatgctcattggtgacatgacaactggacaactcaaaaaagagattgatacctttgttaatgaactaattagttctgaacgtgctgaaaatatgtttagcagtatttcagctaacttcggtaaagaagcaactgagcaagcagtacaggcattcaaagatttgatttacactgttgcaattgctaatccagaacaaacactggaagaagttctacgtaaaaacttcaaataagatatagataaaagaaaagccactacattgtagtggcttttttgctatgcgttataaccaacaatgactacagtacagccaaatggttcaacaacttttaatacaacattatcatctgcatctagttcaacttcacttagtacaacgtgattgtcttcagcatagacttgaacttgtgggaggattttaccatgttcactggcaggaatggacagtgtgtacatagaatcaccatcatctacccaatcactatcggtatacgtgttgtgatatggagtggtgtgtaaggttttaccaataatactcaatgagattggagcatcatcagtttggtacacagtaatattaccgctaggatctacaatgaggtctactccaatttggaataaatcaccactgtatgcttgtagagcaagatactcaccacgctcatgcacagtagctggtacagttgccatgtacataccatcggacgtgtactcaaactgagatagaagtactgaagtaacgaagtcaatatcttcgccgctttctagtatatcaaattctatagttttggtattatatatgtcagaagtgagtatgatggttcctttaccggattgagtaattggatcaactggaatactaaaaacatcatcaattatttcagtagtgaagtactctgttccatcaggaagaataacggtaatacgcattccagtcgtatcaatggctgaacctgcgttgaataggcgaccacctaccaaatcatcacctacgaacgttgggaacataaggatgttgtctatatctctatctataatcccgcattcaggggtgtacatattatatagtgtttgtgaactacctagaattgttttgtgcaaaagaaacttataaacaaacccagtaggatctgattcaagtttagcatctgagtatcctcttacgaaaaaagagttctttcttatttcacttaggatttggtcattagttttgttgtagtttaattgatatccttgtatatcctttgttgtaatttgtactttacgataaattacattacttacaggatcaagtaaatcatataatctatggcttctctgacgatagattcgaacatttttgagtttagtcccatcgttgagaattgcaccatcgactacatatccacattcaccgaacttatatcgtccagcagcagcaatcgatcttgacattcatccctccattggtataattattataacgtatttattctagataggtaaaaaagcaccttgactgagttgtgtttttgacgtatacttaaatggaatatcaataaggggattttatgagtgttgtagaaaaacgtttagtactgaaaaatggtaaaatgactgttaagctatacaaagatgaagctgattcttttatggctaaagcaattgagaaatccgaacgatataaaattcttgcacctgcaagtaaatcgccgtatgggtttaatcacgctcacagtcattttgttggtatggtatgtgaacatgcttcatttgtactttttaatgaaattgaaaactattcaggtattgcacttaacatcgatccagcgttccaaagtgatggtcgtgatggtgaatgtgatatcaaagtaaacaacttaagaattgaagtgaaaggcatcaagtacaaatcgtggacagactttggtccatgtgttagtactcgacagttaaaaaatatacagaaaaaagctgacgttattctgtgggtattgtataatgagaaaaagcaagaattcacatttgagggattcaactatgtaaaagacattagttcgattccagttgtgctaacaggtgtaccagggcgaccaatgattgaaaatcacccagtactgagtattattaaaccacttcaggagttaccattatgattcaggcaactgtatatcaagatattaatgaagaatttaattctaaaattgcatttttatcctttcccgtattgccagctattggtgctacgttgaatcttacaatctgtggctttgaaaaatactatgaagtactagatattgagtactgtgcagatgtttattcatgcaacagtgagattgctattcctgtgcaaatcgacattattgtaaaagaggtttgattatgtttaaacactttctagtaatcactgctgttgtattcagtacttcctgctttgttgcaccagtacatgcggaagaccagcgtcaaacaatcaagacgattggaacagggaaagcccaaccaaaacgtactgctgaagaatacatgcctgagatgcgtgaacgttaccgccagcaataccgtgaaaaacatgctaatgataagcctatcaaaaagcataaatggaatgtagtcaaatcgccatcgttttgtgctgggtatgctaaggttaaggatgaacagcacaacaagcagtactataaagatatgtacacattctatgattcgaggatctcggatgatgacatgatggctgctaaggttgataaagaagaatttcttcagggttatgacatgaccgatgatgacaagatcatggaatgtgttgaagtatatgaaaaatacagaggttttgaatgacacttttgctgattctaggtttattagtgtcatatttcatttttcttaacatcttctctgatgcatcacattttgcatatgcttcagctattgcaaaacacgaagggataaagaagtatattcctgcattgttattctcatatatgtaccatccaaggtactttacactaggtgtgtttgacaagtatgtatacgacgaaaaagcactcaatgaaattgaatactttgtaagaactcatgctaataacaatccaaaatcattaattaactttactgataatcgcaaacgtgttagtattagaagtgacttgtatcctaccagtcactttcatctaggcgattgtagtgtgtacagggttagatacgaaaacttactgttaccaccatcacatataagatacatagaaaaatacttgttgaaatgtgttgactccaaatagtaaatggcagtataatagcttcgtaccgcaataactgacaagaggatttaacgatggacgtattagctactcaattcaaacgcaacgcagaagaacgtgaaggttacctaagtatcagtgaagtggttgaagatggattcaagcagtacattttcaacagtgcaattaaactgaagccaacaaaagattcaccggatcgcagcttcaccaagtggattgcattctgggaagagtcaccaattgcaatcgaaatgactgtcattactacagtactggaaactggttacatcaaagcaattgtagttgataagaaagttcgtactcttgatgaaatcgggacatacccagcacgtaactctaaagtatttgggtgtttagttgatggtaagtttatgattgaaaaagatgctaagaactatgtaattgataaactacaaaccagtgctactaaacaggaagtcgtagaccagaacgcagtggatgctattaaaaaggcatggggactgaaataatgttcacacttagcaatgcaaagtatctatttcttattgctattattggttgggttatggctccagtgcttaatgcactggggtttccagacggacataaacttgtaaatgtttcaggtgtaatccagggcatttcatggtattcattgattatattttctatatgtattcatacatttgcacgtgattgccgtcgtctgctttttgttaaagtattcggtactaagagatatagttttgtgtttacatttattttaataccatgtattatctatgcttttgtatttgattactatacttatctgtgggtgtgtggttctatgtttgttatgttggaatatacaagaactgttcaaaactcatatgctgatgagtattatgatcttgaagttaaacgaaaattaacggagctaaacaaatgaggggatacaataagatttgtatttttgtatttttagtttgtgcaatcaatacatttggatattactgtactgaaaacaacatttcatatggtttaaatcctttgtggtttacaattgccaatgtagcacaaattggtattgctgttatgtctgcacttatgttctgtccaattgtcactatggatactgatcatgaaaggcttggatttatccgtgatactggagacgaaccttatagtagattgattgtgttgtatccatttattgttattttaggtactaacatccaacttgggtctttatctaatagtgttacttcagcagccattacagtctttgcattcacattttttatggtacacaaatcagtactcaaatggcacatcaccaaaatggcagagaaaggtacggaaaacagttgacgtgagttattgagtcatatataattattacatcaaaactgggaaatggtaaggaacttatgaacatcgataaggtcaaagaacttagtgaagcactaattaagaacgaagaagcttgtgaagaacttcgcagtactatcaaagttgagtacgcacgtcttcaagctatgcttcaggaatccgaatgggttgtaactaaatccatcgaagctatctataaggatatcgaatcccttttcaataagaaaagcaagtttgaatctgattcatataacaaacgtaaagagttatctactgcacttggtatctaaaagtatttgacttaaccaataacatggagtacaatgtgctcctaatttaattatcagctaaaaaggaaaacattatgaaatctattctcgttgcagttaacctggttgcttccccatcttttaacttcaaacaagttgttgctgataatctgaagaagatctgtccaaacgctgaattgactttctgtgtgtttgattcagaaaaagtaactaaagttgatctaaactatcttttgaacgaagtacaaagtatttctggtgaaagtagtttggaagtactgaatacggttgctgatgactatgatgatacactggtaatttcggagaaattctaaatccaatgcttagatttatacattacttaatcagtaagttctttggttattatactattgaaggtaaagctacgcttgcacataaaatctttgtagcattatgtgtgggtgattatgacgtattgaataagcactgtaaatctaaagcatgtattgacataatggcacttcgtatctatgagtgtcagttcaatagatataatttttaccagtacagatatgataaagatgattttgatagcattaaaatgctaaagaatttatgtaataataaaaagaatatgcatatatctgaatttgttgcattgtatttttatttaaaaagttcattatacatgaatacacttcaacgcttcgatactggaattaatgtattcaacgataaagaatattatatctatgataaatttttagataaggtttaatatgacgactgtttatattgataaacgcttgggagtattacttactgattcaaaagtgacatcaactgagcaacgttcatttttgaacctattcccgttgaaaccaaaacttagttatggtgtagtttcacaaaaaacattgtatgtacacgaccgactgtttagtgcttgcggtgaagttagtgaaattaacaaagtactgagatacttgatttcacaagagactgtgataccagaccgcaaggcgagttgtcactgtgttctggtgtcaaaagattacatcattcacttaatcgttaataagggtaagtttaccaagaagattgattatctccataatgattatacattctttatgggtagtggtggtgaatacatgcttgatgcagcagtacatgaagagtataatactcttcttgataaggtatttgataccttcatggatgttcataaccatgatatctataccgatgataatattaatgtataccgtttttgatttcattcattaggagaagtaagtgaaaaagcttgatttaaatgcaatttctgaagaagtactggatgagtgttttgctagtgaagaagtcaacgtattagaggctcttgattccgtcgaagaagaagaagaacatgacggtcacaagtttgagaaaccaaaaacaggtatcagcttaactcgccctaaagggataacgaatgaaatgctcatccaagcagtgcgtgatggcatagacgttgaaaagaacattgaccttttggttcgctacaactatccaatggtagtaagtgttgcacgtaagtgtacatgtttcatcccatttgaagataagatttcttatggtgttgaaggtttaatgcgagcaattcatacgttcgacactaccaaaaatgttaagttcattacatatgcaacaacaactgtgtacatgacaatctataacgaaagtgcagatgctaattatctagtgcatttcccacgttatatgagtgttaataacatttatgtgaaacgttgtgttgaagagtatcaaaggaaacatggtaaatacccaactcctgagatggtgtcaaaagagactggtattgagattcaacacgttaagaattgtctaacttacaataacacttatgtagcattgaatatgaaaatgagtaatgattcagaaagtacattatctgacattgttacttcagttgaacctgattacaacttaggcgtagaaactgtcagtaccccactggtacaaagtattgcagaaatgatgagtaacctatctgccaaagaccgtgaattgattgaacgtgtacatggtattggttcttattctgaaccagaaacgctacgagaaatcattgagagtggttttgaagatgagaagggtaaggtcatgactgctcgttcttcattgcaccgtaagtactctgaagcaatggaacgacttcgtaagatggttaagacaaaaggttatgagttcgaagatttttaagattaaagggttgacttcggtcagccctttttttatgggacaaatttattaatggtgatacaatgatctatgtacaatcacaatgacagtactggtactgacaatcttcccctacttcacttgaaaatgtaaaggatagatgagcttttcattgtagcgaacagcaaaagaaacccgttagatgtgggcatagtttgaacccctcacggcaatgcggctgtataaagaaccacgttaggatagctggtggttcctcgatagacatataaggataacaccttacgaattatctaagggagagttatcgaattttgtacaggaaagttgcgtccaaaatttgagtactcacattaagtatttgattgcatagatacttaatgaagatacactatgtttaaaagtgtagaccgtcatatgaaactgaagtagagagaaacaggatgacccgctttcgcactcgttatgagtaatcttcaatgcaatagctctgataccatcagcgtcaaatttccctccgtgcggggggaagaaaaatcccttcctcaaatcccgtcaatattaaaagtccttgacagttatgattcattcgcgtagaatacgtagtattagaagcgaacagacatctcgaagagatggatgattaaccactaaggaatatctaatgaattcagtaatctttttaattattgctctttcaccacaatctggtgtacaaatcaccccaatgaattcaatgaatcaatgcattgcagtacgtgacagtacgtatgaacaagtaaacagcgtttcacttagaacagttggtgaagaattaatgtggtgttacaatagtaatactaaagaaaaactaattgttggacaaacagaatgagttatggtgttcgttttgagattcgttctattgttatcaatgacgagaaacaagcatcgttggatgacgatatacgagaactatatctatcatgtatccgtgcaaaatctgaagcagatgcattatcacaaatgattggttttaatttctttcatggatactatttggtacgagttatcgaagttaaaaaagtcacttttgagtgtcttgctggagaaatataaaatgagcactatagatgaattgattcgccggaattcaaaatactacgaaccatcagaaattgtcggcaacattactaaatctgagttcggaccaaatactcgaaaactcattcatgtaatgtcacgtgatggctttaaatgtgattgttgtggtgaatccaatgtggtattcactttacataagcacagtactaaagaccgttataaattcagaccttatgtacttaaagggaaacgccttgtacgcatgacgttagaccataatgtactggactgtcttcagggcggtaatgataaagagaacatgactgcattgtgtgaggattgtaacgcattacgccagcataagtttgctgagtacagtgagtttaagcactggtatcataacgaggatcgttctatcgagcctgacgttaactactgcttcattgagtatattaagaatgctaaagatacatacattcttaaatcaatgtcacctattacagtgttccctgagaatctattcagtactatgcagcgtgattttaaacgtggtatcattaatgcattcaaacatttagacaaaggtatcaagcactttgaggtgcaatgcttaaatgaaggaatgaatcgtttagtacaaatttacatgaaatcatttataggtgttgacaccgcacgtctaccagtatataattactttattgaaagcgaagaaggtgaatcacttcgtgattatggtgaaagatttaataataaagtttccactgcaatcgcaaacgagattcattactataaaccatgtgtaatttaattagaggatatatcatgcaaatcatcattcttatcgtaggtatcattcttggtgtatatggtcactcctggatgaacgagaagttccctaatacccgtcctgagtattgcagtactaatgtattccagaatggtgagaaaccaaaggatagtattggtaagaaactggacaaagtacttgatgtgatcaatgaataagggccataaaatgtttaaaccgaattccaatgttggtaagaaagttcaattacttgaagatgtatccaccatgagtggaattttcccaagaggtcacatcatgactattattgccgaaacatcccgtgggtgggatttggaagatgctgatggtaatcgcatccttgaggctggattctatggtcatcgtgaatataaaatcgttgattaaggatacaacatgactttagagattgtctttggtattgttagcttagtcgtctgtgtgggttggtttgggtatctgatgatttttagtgattaatacttgacataagatatcagtactgtataatgtttatatcaaacgaaatccactttaaaaaatgataggaaatattatgtctttttctaaagaagaacgtgaccttattaaaaaagcaatttggttttatgctaatgaagggaagtgcgatgaagaaaaagcacgtgaactgtgtaatatccttgagaagaaacaagaactgaaagtgtatcgtatccgtgatttggatgaaggggatcgtattgtcctagctgaaacaaaagaagaagcagaacaaatcttcactgataaaaacgaaaatccacattggatggaagaagtctgtgaagtaaaaaaaggtacttatatcgattgactgtactgaataatagcagtataatgtttatatcaaagggaatgcagtgaaaggaaagacagcataatcgtactcgtcactgcgtttccacccttttaaattaaatgaggaattaactatgtttcaaactaacactcaaggttttgtaatcatcgatttgaaccaaaacagcggttattggatgaaacctactgacgcatgtatgcagtttgattttttaggttacaggattagtgtaagtactggtgcttctgtactgcgtggtggttgtatcgttgaacatctggtaactgatccagaaggtcgtgagtatgaaatcgcaggttcagtacaagatgccattatgtttgtatgtcagcgtgaaatgaatagttcgaattcaaatgcactgactcatgctctttctcaagaagtggaggttcgttaatgaaatatatcgtagcagtactcgttgcatttttactcactgcatgtgacgcttcaacaaaagaacgcacaagtgattttattctccctattgaattacaagaagcaggatgtaagatttatcgtatgcaaaaggacggtgctggtgtaaccttgtatacagtttattgccctaatgcaaataccagtactggatacagcagcggtaaaacacgaatcaatacttcagtgattaatggagtacaacaatgagccttgatacaacccgtgcaacagatttattaactcgtatgaataatgaagaatttcttgctgaaataaagtacaagcttgaaaaactggcacgaagtgctgaagtaattgaagttgaaggtcacttaccaatggaccaattccatacgttcaacgaagatatggtttattatccaaatgaaatttggattgagtgggagtcatggactaacaaaactctacgcattgaaggttattgtgtgaattatgaatctgaacctggtgatgttacaaaaactctctccatttggtgtacaaaaacacatgaactcgttgaggtgaatttgaattatatgaaaggtttccgttggggtgatgttcaatgattaaaaaactattgacagttgtctttgtattctgtacaatgtttcttacagcatgtaatgatgacggcaggtttagtgcaaaagacttagttcgtcaggattgtacattcacaggtaagtcttttattaacgagtatgaaatatgtacacaatcaggtcgtatctgtggtggttgggaaaaacgtcaggagcgattgtatgtatatgaatgccctggtcatctcaacaaagtactaagcacacacaaacttgtttatgataaggttgaataatgactaccaatgaaatgatgcaggttatttgggataaaggttgtgatattaaaatcactagtactgatgttcgtgtattcaaaactgaatatatggagtacttggaccttgatacttataataatattgtatcaattgaacacaaaggtgcagtactggaaacaattgacgtagtactgaagaaagctaccgacctattaggagcggcagtgtgaataacaaagagtgggaagagtaccgtaagaagtgcagggagtttgataaagaactaactggtacagtgaatgcagtaatgtgggtatctgtaattattgcagttcttgcgttgggtgctattattattaataaattattctaaggcgaatatcatgtttactttatatctcgcagtagttctcaccaatggtgaaatcactcgtactattggtgaaggtgtatataaaacaccagaccagtgctactctgctactcattggcctcgcgatagtggggatgaaactcgcactgaattcaaatgcatgaaagtaaaaggtgattttgttaaccttaaggttatcgaggcgaaataatggatattaatgagttgttgatcttattgtttaatcgtggaaatgatgtaagacgttctgaatatcaagacaaaattcacattgaaactgataaatgttatggtaaaacaactcatgagattttgaagccaaatggcaaacgatatgccgatgtatgttttcatgaacgaagtgatggtagtgaaataatcagtactgaaattgtgttttatgatagatcctcggcaggttcgtatgaaatagaacttatatattgtcctggttcagaaacacacaataaacgtcagatattatatgatgtttattcacctccaggtgtagctgaatattttgttattgattacagtactgaagaaagtgtgtttcaacagagcttgattcataacttccagttgaatgatccaaatgtaccaaagttgttcaaactactcgatactatcgatgttgattttgaatttgttatgtgcattagaacttccttgatcgatgaatttatggaactacttaatatatgaatcgttactacattgtgtatgagcatgtatctgagtttaataatgtacgtggttataagaaagaagtacagaagattgatgtatttgttcgtgcattaagtccaacacatgcactatttaaattgtttgatgaagtaactaagtacaacacatcaaaaacacaacgctatattgaaaccgtacatagtgtaatactcactgaatatgatggagaatgacaaatgaatttatatctagttgaagggtcagtacaagtatccaagcaagacggagaagggtatcgtttttcacatgtagaatattttaagtacgtagtaaaggccgatggtcagtacgacgcagaaattcaggttgaagaatcattccgtaagaagaatgatattggtaaatttgaataccaagacttacaattcactgtatggcctagcattaatgactaagatgtggtggtgtcatggtgtctacaatgtctatgaatatggtagattcaaaatgagcagcacctatgccagacgtgttaatgcgaaaaaccaagttgatgctgcttgtgagattgtagagtggtatgcagagttcaatgcaattgattttatgtacgaaatagttacaataaatgttgtacaaattgacacgtctttgatataataactgtatcaaaacaaccgcaactgaggatactatgttagttaatcttaatttcatcacttctcctgattgggcattgcgtggtgtttctttgaactttaaagaaactaatttcgactacattggtgattgtactttagttaatgctaaatttgatcctcatcatcctttttgggctgaaattcatgatcctaatgtaaacaatagtacatctgttatgactattgtacagacgaaacatacaggtatcctcgcaggttacagaccaggacatgcgattgaacacttcactgattatgatgtagtagatgagtatccaatgatccatgaagatggaagtttatacacgtcagaagacttccgtgctatctttaatagtactgatgacattctaccaagtggtcgtccacgtcctgagtcttatcttatgcactcgtcttatggtgtagcagatacgcttgaacagattttgacgaagtacaagaaccttattgaaggtccagaagaaattgtcttgtgctatcatccagtactgaagtctgaccaaccagagagtggtgggtggcgttggcataagaatggtgagtacatcggtactaagcgtagtaaagaacgctttgagtacttgtatgatgagccagatgttgaggttgttttatgttataattttcttaaggtgaaaaagaaatgtatctagtattgagttttgtagtcgcattattgtttatgttctaccctacactagtagcaatagccactaaacgaaagctggtggatatcactactgtaggtttgctaaatgtggcactcgttctagtgtctattatcattcccgtgagctttacggttattgacatggcatctgtattactattcgtcttcagttatcttatgcttattgaagaaaaacctgttgacaaatgtttgtagtactgtataatggttcttgtagtctgaaacttaacacttaaacttgaggatataaaacatgttatcagttctaatttcaattcctgctctaattctgttatgggttatggttttcgaattcttcattaaagacgaaaccgagcgtgatgagtttcgtgagttgtttatgttagactcacccattgtacgaatcttcttcgttgtagtacttatttcagtactgtcatggttagtaagttttgtattaccaattggaccatttgtttcaattatgaatttagttgagaacattgttggtattgtatggtttactaatgcattgtttgctggtaaagtttccatttggtttgatatcttgaaagataaactaactagtaagaagtaacgttcaaaaagtctctaatagtattaaatacttctgtacaaataatatgtgcagaagtattgctcgttagaggttataatgaaaaaatatataagaatgataatggtgtttgtagtattcatgctttattcaaggttcagtacagccgtacctgcttaccttgattgtatgggaaacgatggaacatggcatgtactttctaatgacccacaaaatggaaacaatattgtcgtagatgatgaggtttaccgtttcagggccgagagtttgattgggaataaaaaggtatcgacatataaatcagatgctggtataatagcaaatgtaatattgatagtggaccccaagacaaaggatggggatatttacatagtcatttatcaagattcgtcgaataaacgcgatcaggacattgataaattgaatattcattgtgaactgtaaggtataacaaatgataaacgatgtaatgctttatgtattaattactccgattcttattaactcagtaataactatttcaatggcattatttggtatagcagcaattgtttatgctgttagtactggaaagtatactttaattagtaaggttgattcatggttcgcatctgatagtgtaccatattcagctagtatgattacgattggtattctaatcgttgcatttacactgcactgtattggttttattaatacaagtattttttcagtttttattggtctatcattatatccatcactttggtacttgatttatgtaaccgatgtttggtataataactacaagcagtacaaagtgaagaaatccattttatccaaaggaaacaaatcatgaaagtaattttgttttttgtttgtatgattatatgtggtatgtcttatgcagaaccattacctggactagtctgtactgaaggtgatattaaacacatttaccaaggtgatagcgatgaccatactatcgtttatatcgacggtgaagtgtataattttgttaaagaacataccgtaggtgacattagttttacgcagtactcgaacgatactgatcccaatatgcttgcattttcttcaagttgatgtatatgaagatagtaatggcgaacagtatgttaaacttgtgatgatgcgtaaggcagcaaaacaggcaacattcggtggcttgtgtaaatatgaggactaaacatatgttgatttatcaatgtggtaacattcgtgttatgcagcatccctacttacaaatctttgatgtgcagcagtatatggaaggtgatgacccaagaacctatggtcgtaagtatgattacttcactgtaaagcagtgtcataacatcaaagaagtacgacaattagttcaagaacttcaaaataaaggttgacttcggtcagccttttttgttataattatttcatcaaatactggggattttaattatgtacgtatatcgttttgaacttaaattcagttatattgaacctaacttagatccagcaaaaacagtaggtccgttcgcacggtactcttcacgatacagtactaaaaatggatttgaccgtttgtgcatgaccacgccttcgcaattccaaccagaaccaactgaagatggaatctattcaatcaaacgtggctgggcatttggttgtcagagtttgaatgatttgtttaagttctttactatggacttgggtaaattacatcgtgcagggtttgctgtatcagtatatgaagttcctgataatcatgttgacattggtcgtagtcaggttcagtactattgtggtagtgccaatctggttcgtatcatgtcagtgagagaagcaaaggatgagtaccgccaaagtaaaagagtaatacatgaggctgtatatggataagactcaaatagaattaaaaaaatttgtatcgttttatctacccaatgacccacgttgtacacaatatgatgttgcatattacaatgcattgactacacagttaatgaagaaattcaaacagtgtttgactgtattcaatgatgatggtagacgtagatatagaatcattccaatgaatgatgaaaacgataactactttgactttgatgttgtttttagagcatacagtgatgatagaataaaattaaattatgagcaaataatgcttgacctcagtgttatctgtgttataattactcacatagccgaacttgatggtttaaaagaatggtattaacttagaggataatcatgaagcttaaattacaatacaatggttttactttgcgtaacgacactgagtttgtcaatcgttcaccaggtgctgagttgtttttgcgagagatgaacattcctttcgtcatcactactgttggtgaccgtgaagtgctacaatacgcagagcatccagttattgatgttccgtggtattctgagcatatgtacatggatatggcccgtcgctacgactgtaagttcgtagttgaaggtgataaaattacagtccaattcaaataaggtaacttaaaatgatcagtacttcagtaaatgcaagcatcgtggcagacgtagaaatggttaaagaatgtacagacgaaacccttcgcaacatgtacatcaatgatttgatttcagagtacggaagtcgtggtgttcatgagtttgttcgcctaagcggtgaattgatgaagaatcgcattcgtatgaagcttaatgtgcatccaaaagcatgggcgtttacaatgaagtacgctgaagatattgttgcgttgcgtcgcaatgatgtgtataatcgtttacacaatggtacattaaaggactaaattataggaatccgtaaaaggattcctgttcttgtttataaggtaataaaatgaaatatctagtactagtactgctattcttgagtactgttgtatgtgctaaaccaaagtatcatgtagtgtgtatcaacgagatggaaggatatactgaaacatataagaaccatattgttgaagttgtagcccaaggttcctatgggaccatcatcttccttaagaacaatgtgattgttcagtacaaaaaagatttaaattgtaaagtgactaaaaattgatctagatcaatttttcagatattctctgtaaataatagcagtacagaacattattttacggaggtgtaatatggaaactataatcatcatatgtgcgttgtttgcatttttggtaatgtggtcaccaacattcattgcatataaaatgaaaaataaaaatgcagaagcaattatgtacgtaaacttatgttgcatactaacttatggaatacttttattctttactgaatttacattaatcccagtagtagtttgttcatcaatgtttatttggttgtttctgctttatgaatctattaaaaaataaaagatatagggttggtataataccaacccttttactttatgtggggtttaattaatgaatagaaaaggtaagtttaaagtatcaaagaagaacaaaagttctagatttagacctataactttaacttttaaggctaaagaagaattaactgcacttagtaaaaagataatttcatctaagattaaagtatcatacgtaaattcggtaaaatttcaaaaggttaaaccacaagacaaactcatttcacttatatttaaacgtaatgattttgagatattagtagatgattatagagcctataatgctggattcattcatgtcacttgtaataccgaactaactgagttggaacatttgacatgtatcataagtgtagataacggtgtggtgaagtacaattttttacattttaccaatatcaataatggaatgggtgtacaatccagacctatagtacctacatgtgatgtgactaatttagcaaagctcaatgaagaagaatattttcaagaaagcattgtaactgagcatttagatgctataatagcaacttacaaagaatgcatatgggttttgaatgcgataaagcccaaattgtgtttaatgaatgtcgttcgtgatttataactggagatgtagtatgggttggattaacgttaatagcattgaactaaatgagcaagacatatttgcctttgttaatttggtagagaatattgctattaaaggtcgtctgtttagttcatcggacggtaaaaaatggatctctcttatgaacgacaatggcgagatttatgacgttatacaactacctcattgggcttataagaatacatctgatgatgtgatggctgctgttatgcgtgagtttgaaaagctacctggtggtgatattaagaacatcgtattcaatgcagaacgcatgaactacacaccagagcagcttcaacagttggcaattgctgcctatcaagctgccattaagaaacctgaatgtgtgatattaaagtacacaccggacttgaagttaacactagaagatatggattcctttatcttcagttcagaacttaaacagtactgatttgactttggaacaaccatttcatatgtgatataatcttaagtgtctgtggaaataaacagcacatgaagtataaatattaaagtaatttatctctttaaggagtatgaaatggttgataaatggaataagaaagatccatcgcatgatgtggatatttctggaattgataatgcacataagcataagtatcttgattcactaggtctactaaagcctgaccaaagtcttgcacatgatcgtccttcacgcgaaaaagctttcagtttagaatcactaggccatgaattgaatcgtgtatttgaagatcatccaatttatgtacgtgatatcattgagaaacttaaagtgactcctaaagagcacttcaaggcaacagtacatgcagcattccgtgcactacatgaagcactaaagaaaactcataaccttcgcaagattcatgatgacatcgtgaactctattgaaggcgaaaaacataagtttaaaaaataattaaaaggggttgacttcagtcagccctttgtcgtataatattttcatcaagtgatacaaaatacaaacaacgtgaggtattaaattatgcaaggtactaaattcatcattgctgccctaatcgctgctgttgtagtgggtacagtatgttattcaattgacacctatatcaatacacctagtgttgaacaaaccaaataagggatatcatggctgaaacattatcactatatgcgttagtactgttatttgtcggatttcttccctcactcattacagccattcgtgttgttaaacatgaagctgcattgattgtatgtagtattgggtcgaacattctattgtatttctttttgacaaacactattgtactgttcgctttctttatcatgattctgtgggtacttgtaattctcggattcttcatttggtcattggttgatcctaagaaaaaaacaggagaagtgaaatgaaattaattattgtaatgatgatgtttttggctttcccagtactggctactcctaatctggactgcacactgttgcgttcagatggtgacacacttgaaatcaacacatatgaactctttggtccaagtgtagtggagaatgaaaccacctacaatttcaaagctattgactttgaaggtaatgttccagtactaactacaatgactattgacaaaactactttactcggacgaatcaccacacaacgcggagaaagtaaaacattcacagcgaaagctgactgtaactactaatggtatagtacagtgaaaatagggttgacttcggtcaaccttttctttatactataaatatagtcatagagaataaacaatatgaaatctatggagagaaatcaaatgccaggtcaatttactgataaaaatggcgggaacatggcaggtcactctgataaatggagtgaacgcaatcgtcgtcaaaatagctaccaagcaggacaggggtcacgtggatcacgtaatcaagggacaggtttagctggtaaggcaaacgcagaagcaggtgaagttaagagtactgagaacatgactgagctagaaaagctacgttatgttaactcattaggtcttcttaacgcaacacagaaacaacgccttgctgatatggaacgtgctgagaaagaacaagcagttcctaaagaagaaccaaaaccagaagctcctaaagcagctaaccctgttaaagagttatctgataacttaggtaagatctttgctaacaaaccacagttgattcagggtattgtcaaagcactacaggcagttcctaaagaagaactcaaaggtaaagcacaagctgtacttgatgcaatgaaaggtaataagagcactgaacctactgaagtattcagtactatcatgcgtgcacttgaaggtacacacaaagaagattccaaagaacctgaacagggtgaagcaagtcttgatggtattcttaaaacttttgataatattggtaaagcagaccgtgctaatgcccagcaagtcaagaatgtactggctaaacttgaaaaccgtttagaaggtaaagacgataaggttaagctcgtatcagatgcagttaacagtgcacttaaatcttatgtacaaggtgagaaaagtcgcttcgtaacagctatggatgctgcattcaacactatgaaaaagtatgaagcagaacatggtgagaaagtgacacctgatggatatctactacgtaaagatgaagaaggtgcagttgaacagaaagatgttgagcctgagcaagaagatctacctgataccgttgatatggatggatacattcatcgtcctgagatggaagagtttgggtcagataaagaaggttttgaacatgcaatggcagtatataaagcattagttaaaaatccagattatgctaaccgttttgttgacgagtttgatagtgcatggaataactacaaagagaaaggttatgatttccctgctgaagctgcattctttgaacttggtaaactattagctaaacatggaattgacgttggttcatctgattccgaaggtatggaagaagaacatcttgaaatgaccgataaatcaattcatgaacttcaaaagctaatgatgtggatatccgagattggtaaaaaagcaggtgctgatagtaaaagtatcaacaaaaacattagttggattaaagataatgttggtaacaatgctcgtaaacttcaaaaggcttgggctgatttagtaaatggtgcagatgatgttgacattgaatcaccagaagcatatgagtatgcactaactacacttgataactcattcaaagagtacgaccgtggtgttggaaaggataaaaaataaacatttaaaaggttgacttcggtcaacctttttttgtaaatattgtagagggttttataagaggtaatgcaatgtttaaatatgttttattttcacttgtattgtttactgatatagtttatagtactgaataccagtgctccattgctagacaggagtttagaaacggtgagttctataccaagtcttacactagaggattggtacatgacaataataaaactatagggttcaatgcatttgataacaaagatcgatatacgtctggaatactatctgaacgtaagtcggatatactaggtatcgagcgtgaattccggtgacacggttgcaatgtgtaatgatattgagagtactaagaaagtatatactaatggtgaaaatacttttagattccacaatcttactaccaatgaaagtttatacttctacaactgtaaagagttcattaaacctgtggataactcatgtgatatgccggagccaaaagctgctgtatgtgaggaaccacaatctaaagctgacaaagattcaaaagataagaaagacaaagctgacaaatcggataaaaaagaaaacaaaaagaaagctaaagatgataaagataaaaagtcccctaagccaaatccatttgaaaagccaaagaatgaaaagccaaaaccagacatgacatgtaaaatataaaagaaaagggttgacttcggtcggccctttttgctataatcatttcatcaactactggaggcaaacatgttaaaagttattttccgttctatcagttcattacttcttatgattagttcagtttgttatgcaaatgaagtatctgatttgtttgagaagaattacccaactgcacaagagatgggtgttttaaaatgcaagctaacttcgtacaacatcatcggcagtaaacttgtactggaacatgaacgtagtacaccaatccctctggtagaagaaggtagtacctttagcttcaagtacggggtaaacgtaacatctggtgtaatgaacaatgttgatgcagagactggttcaacatggagtactagcggtaaagatgtgtttcatcgtatgcgtgaaaatggtaaactgaagtacgtatatgaaagttcattcatgaaacgtgtattcattataaaaaattgtgtaccagcataaggaacaacatcatgcgttcatttgaaaacttaatcggtaaacttcgcttacaagaaattgaagctgatgtgaaggaattatctgaaactaagagttacattcatttagatgaactgtttattaagtacggtgagattggttttaagtcattatttgtttttgtcatgaaggtgcatagtttaaagtactttgatttgagttcaaaagacggacaaccaaatctgtattacatgtattatcttaagaacatagacgaagctaatacattattcttagaatatatgtaggggtaaaaaatggaacaacattttgaattaattaataaggtatcattttatgtagtatcgttaatttgggtgtattacatgtttggttacattattgcattcttccgatacacgaccttgtatcaacgcatatactacgatgcaccaatttcatttttgatgttcagtgcatgtacgtgggggataattgaagtactggtatgtggatatagtacggacgaattaaatctcgtatcggtgttgacattactaacaattgctactatgatagctacagttccgatattttttctctttaaactgcttcatcgcatcgatgagtggcgtaataaaatccctgaaaagtaaggattgataatgattttttacactaatgcgtttgcttatgccgttgcatcaatctacattgtgtacttcttatttggtggagtactgtacttctttaagtacaaaacattgtttaaccgaatgtatccaaatcatccaattgtagtagtacttttgattatttctgttgctcacatcattgtagaaacaataatgggtatcagtgcagtacattacagtctaggtactattgtaattattactatgatcatcgcatacattttagtaatgggttttggtttatttggaaatgtagcaatgaaattgtataatcgaatcaaaacattacgtgataatctaccggagcgttgagatgtataatttaaatttaatatcatatatcataacaacactgtttactttctatgcctttgttggtatactcctactgtactttaaattttataaactttttgatcgtttttatccgtcattagaacatgaattcttattagtgatgtacatatgtctaacgtttatgtctacatttttcactgcatctgatggtatcattggtattaaagctgaagaaccaaatgggagtacgcttgttgcctttattctggtaggatttttcagtacttatattacctttatttcaggatgtaccgtgattgattatcttgtgaaattacgagataaaatgccaaatcgatagtggattgctatgtttgcattgcgtaataaaaaatacaaaagagattctatgtatctcaatagtatgggattgtgcaggaagtgaaatgattctcgaagaaggttcaggtgattgtgtttatgttgttcaggatcgtcgcgaactggaatcattacttgacgaatttaatgctggtggaaatcctaaaagtactcaattccctgagatcaggaatcctgcaccaccaggctcttatgaaattctacaactgtgggagatggataagtaatgcgtcaaatgcacaaagtaaccgagctaaacaagcgtctgattaaacaatcaatgtttgaggataaagagtcttactataacttcaaacgtgctgtagaggctgctatccacattcagaagcttaaagatagtggatgtattattctcgaaaatggttctgacgttgttactgatgacttcagtgtagcgtttgatgtttcacctgatggttcgctatcaatgccacgcttagggactggtgacatgactgtgtgggtaggtttcactatggggaatgtaccaggcacggtgtatgtagatgatgctgagttgaaagaaagcttcaaaaacttatcgcatcttgaaccacaatacgcacatgaaatgaatttattttgagttgacaaactcattcagtactgtataatgtttatcaaggggatgaacttctcatccccacaatcgaggaattgtcatgattacttttaagaaaactgctaaccacatccatgagatctacattaacggtcacaaagctggccttcttcgtttactcgcccatcatccgaatgctaccgtatctgataatgaacctaaagattggcgtgtatttttctttggaaagtacagtgattttcaagtatcaaacctgaagaacattcgttcagtatgcacgttaactgaaattaaagaaaagttaaccaaagcattgaaaactaatccagatggtgttcttccacctgataactttgtagagaaaggatatgccttagctcatttcaaagatggtactattcaatctatcagtactgaatatgaatatcaatggactgagtacttcacttatggatcgcgtaatacattgatggcttcacgtagtaaattggaagaagtactgactcgtatgaatgaacgcgagcgtcaattttatgacaaaccagaaatgtggagttcaacttacattgaccgtattgactatgttattatgactccaatctttgacactgcttactatgattctttgaaataaggacaacttatatgaaactacgtactcgtaatctactgatggatgcactgtaccatgaacagctttcactgaatgaagtgaagcgtcagttaatgtacacatatctgttacccgctcgcgttgcaaaacaacgtgctaaagaattgctgaaagaagcaatcgagtactgggaatctgattcgtactaattgtcacgttaattaagtgaggcgataaatgaaaattttattagttctaatactactaattgttttaccatttacgttagtatcccctgaacttgcatggaatgtgtttgtgtacttactatgtactatggtagtaaatggtatcttgttcttagttctattcataaatggaataggacacggtggaggatggaccagtactgctgatattgtacataaaaccactatgtttttatttgtagtgtggaatttattctggacttggtttgtgttcttctaattaaaaaatatgaatatagatttgaaaggtgcaacacgaactgttatccttattggggattatgctatcaagattccaaccttcaaaagttggaagttattcctaaatggaatgatagctaacctcaatgaacgttcatggatgcagtactccaagcgtagtgatactggtatctgtcctactttgtggtcatcatgtactggactagtaactgtacagaaacgttgtaagccagtacaacataggggtttattttgggtggagttgtgtgctttagcattgaattcagagttaagtactgacttcttctattcagatgcgaagccagaaaactttgggtatctgtgtggtaagttagttaaacttgattatggagattaatatgtacgcattgtataataaagaaaagaaacgatttgctaaggttgaaatttcgattgatacatttgacatgttggagtactgtattgtaacggatttatatgctaacttgtattacgttcttgatgacgtatcagtactgcaacgattgcttgagaattccaaaagccaatgccagggcatctatgatggttcatcttatgaaacacctgagtgttcctacggctatctggacgggtatgagattgtgaagttggggattgttgaataaatggattaaacaatgaagaagtgtatcacgtgtaatattgaaaaagacattagtgaatttggtataagaaaagatactgggaaacatagaaatacatgcaaaggttgtagtaatattacgagtaagaaaaccagaaataaaaaaactgatgtcaaaaaacttgaagaaatcaaaagaaaaaataaagatttcatgaccagagttaaatcattttatggttgtagtatttgtatgatgaagtatccagaatgtttagactttcaccatcttgaccctaataccaaagaacatacaccaagttctatgttcagtaaaagtcgagatgctataaaagatgaaattcgaaagtgtatgattctttgttctaatcaccatcgcatggtacatgctggtagactatgtttaattgaaagaaaaaagggttgactacggtcagccctttttgctataatcatttcatcgaaacgagaggatgaatacatgacacgcattaacttagtacacgttaaagaacttgctgaccaacatctgatggctgaatatcgtgaactcccacgtgtatttggtgctgtacaaaaacacgttcaagcacgtaagcgtgtacgtgatttcaaaattaacagtacttacctgttgggttcaggtcatgtaacattcttctacaacaagttattgtacttacagaagcgtcatattgatattgtcaacgaatgtctgcgtcgtggaatgaagattcaaaacactgaagtaaacgacattagcggcttccctgctgagttttgtaatgactacgcaccatcggagtcagagattaaaatgtctcgtgagcgtttgattgagaagctccagatgaagcctacttggtataaatttactgacgttgacttacctgattactataccgagatgattaaataaatagagattaaaaaaatgatacttgacactgctagatacaagtttacaaacaatccgaacactgtccgaacactcaccctgaaatggtggttgagacatcgtgatactgatttgaatacacaaaccgtatcagaacttatctcgtcaattatagaattaagcgatgatgattgtgttgaaaacaatatatataatctatggaatgattatattaacataacaaagggttgacttcggtcagccctttttgctataattatttcatcaactcaagaggtaatacatgaaactatcttttatacgattagctgaattcttcggtactgatgtaattactttacaacaaattgcagacaatacttcattaagtacacaagaagtacttgacttagatgtaattaagtgtgataatacttcaatcgatttcaaagaaggtcttgtcgaaaaagataagattcaagctaagattaatggtgctggacgggttcagtactggaaaggggttttaagtaatgtttgatattatcgtaatagatgacacgaagtataaagtatacaaagctaaatttatatcttcctttactttaaccaatacaacgtcgaaaacaccaattgaacacgaggaagatgtacttgaatttttaaaattatataattcacgaaacaatacaaatgttgaatatgttggcttccttttgaatgacataagtgaatatgttaatggtaaaattaataacatggtatttttaagtgatggagtatattatattaaaaatatcaatattgtaaaatctgaacttaaaagtaataaagttaaatttaaccagaaaaaattaacaaaagaattgtgtgaacaacgaataatttctaaggcagaaaccaatggtgatgttttcttgaaaattaattcgtttgatggtcatcttacagcctttgatattaaatgtgggatatgtggtgaagttgttgagaaaacatacaactcgtacattttgcgtaacaattatgcccactgttctaatattcgtagtgaacgtaacacttcatatgatataagtgcgaaaattaataatattaaacttgcaatgaaaaaatacacatatgaattttatgatgaaaacggattaagtgaggtaaaatcaaacaaatcaaaacttaatataaaatgtcaaatatgtggttgtaaaaaaacctcattagtcaaggctattttgtcaggaaaggtaggattatgtaaaaaatgtggaattgaagtggcgagagataaaagaaaacaaagtgatatctctgtttacaatgatatagaattattcggtactaaaaagaattttatattaaatgaagataaaaaatttacatatgtaaacaatacaactaaaaatattccaataatttgtaaagggtgtggttcttcaattgaaacatcccttggtgaaataaaaggaaaaggtggtgtttgctacacttgccgaggtaataaaatatcagaacgccaaaaaatctcatttgaagaaattaagagttcattggaaaatgctttaactaacagtttaatgaaacttgatgaagataaaaagtatacgtataatacagttcatgatttgaatgtacattgtaaatgtagtgtttgtgggaatgaggattattttaaatattattccatcttatcaaatggtgcaaaatgttctaaatgtgaacagtatgcagggtatgataagaccaaaactggatatttgtatatacatgaagttggtaaagaatattataaatttggtatatcaaataaaccagaacagcgtttcaaacagtacaaatgtaatgtattaaacacaaaacaatataaattatacaaatctactaatggaaaatttatttacgaaatggaaaagtttattaaaaaatatcctgatttggaagttggtgttgtaccaaaaactttatatgaatcaggatatacagaaaccattaatagaaatgatataaccaaactactaatgattattcaagagtttacaaaaatttatgatgataatgttcttttagaagaaattgaattacataattaaaatagattaccgtgaatctttataattatacgatcattactatatatgaaatttaacatattgtgtaatgatttactacaatcctcaaaatacgcaatcctgataaaattaaacccattatcaattgcgtattttgttttaatttcatctctttctttcattttattatatgattctatatcaccatgtatatattctctgtattgaaaatgttgttctccatcatactctataagtagattcaaactaggtacatatctatcaaatggtaatggtctaactaacctacaatcatcaaaacgtttttctttttcaaattcagggagcattggatctattatttctttcagcttatatgattctgttgattgacattctgggcattttgttccgtgtttagtgaaatgataaaaattagtacttgaccatttgtgacctttatcacatgacaggtgtaaaaaagttttatcaactcctacatacacaaattcatcacacacatatccatatgtcaaacattttttattgaccatttcttctgcttcactttgtgtaaatggaacattgccactgcattttggacaacctgttttgtcattaacaaaactaagatatgatgttgtattccatctatgacctttgtcacacattaagtgtaaaaaagtttcatcaactcctttataaatgaacttatcatatgtgtaattcattatctcacaacgggtacgaacttcattgtctgcttcttcttgtgttttcttctttatccccatacattctctgcatttaacaccttttctgttgacaaattttgcatatgatgtagaattattgtgatgcccattagggcatgttaaatctaagtaagtttgtaatgacccaacatactcaaagctgttcaacgtataattggtttttaaacaaatttcttctacaatgcgtttagcatcgtttggatttatcttacctggcatattcactaaacctccaataaaaatgtatttatttgttgacataagtgtgatttattggtattatacaaacatcaactacagagggtaaagaaatgaaccgtacagagaaagcaatccaaatcgaaaagaacttcaactccatgatggcagcacttgaatgtcttctggatacacaagctaactctatcaactctctgatcgtatctggtaaaggtggtgttggtaaaacttataacgttgaccagcgtttacggaaagccgatgataactttgaaatcgactacaagaaaatcagtggtaaagtaactacgttgggtctgtatgaagcactgtatcgttcacgtcatgcagcatcagtactgttacttgatgacgttgatatcttctctgacgagacgaatattgatttacttaaagctgtactggatacttctgagaagcgtgtagtatcttacgctacttctgctaagtacctggaacagcagggtatccctaagcagtttgaattccgtggtaaagtaatcttcctgactaacaaaaacctgtcacagattgctaaaggtaaaagcagcttagcaccacacattgatgcactgattactcgtagtatctttgttgacctgcaactgtttaccaacgaagaagtgatgattcacattgagaacatcatgaacaaaactaacatccttgagaacaatggtgttaacaaaaatggttgtaaagcaatcctgaactggatgctgagcaatgaagaccgtctgcgttcaccttcactgcgtatgccagtactgatcgcgggtctttacaataaattcccatatgactgggaatcaatggctgaaaatatgttccttgagaaaatttaattccatattgacagtactacactatggtagtactataacttaatattcaccaccggagatacgatatgcttgagttttttaattcagatacaatgcttagtattactttgatttatctgtttggttttttcttttatcatgcactagttgtagtactatggtattttaaaaagaaaatcgttttcaaactgtatcctgatggaaacatttcactacttcttttcactattatccaaggtatgtttgcaattgttggtcttatcgcacacttaatttattgtgctaatccacagttgaactcaatatcacaatatattgtattccttggattactaatttgggtgctgatatacttgtttaatctcatcattaatggtagagcaaaaattcgtggggacttctaatgtttgaatcttatcttgagtttttaaagagtagttctgttgcacattcaattgcagggattattctaacaggttatgtaacattttgggtagttatgtttctaggatggtattttaaacgacaattctataagcgtaatggtgaagattttatgaattctttcgttaatcaatcgttgtttgcatcaacattgatagcatgtattgtagcaacactcacaggaaaggtactaccagcattctccgcagtttacggtacattgggtatgatatgtgtagttttttacttgatcattaaactttgttgtgttatgattgaccttcgaaacaagataccggaggaatgatggaatattttttacacttactgccgtggtatatgaaagttagtactatgtactatattcttagtgctggattctactttctgatgtggttcttcaaacgaccaatttcagtattcatctctgataacatgctgcaattaaaattacacgcatggttttttatggcgatgtttatgcctattattcactactcaatgattagtagaggtttacgttctaatggtgaaccaattatattagtattctattggggttcaactattgcatatgtaagtttgttgttgatcccagccgttcataaattacgtgctaaagttcctgatgcgaggtactaatggatatcttaacattgatttacacgctttattcattctattttattatgtgttgggttggatttttatttgtactgaagatgtttgattatgttgaaaaacagataaaagaattttgtattccttttattgggtcaaccattattagtattacttgtttgtattatttggtatgtgatccacctgatgatacagctatgattgatttcatgttattgccaacaactgttatttttttatgtagtctgatgccaccgattagccgtggactaactgaatttagacgcaatcaaaagcgtaaacgagggatgtgatggaaattgcacttattatattaactgctatgttgtttattagtacaattgttattattggcaagttcttctgtgtatccttcttggaaaccgtatacgatgaaattgctgatgattatgaattacatgcgggattttttactacgtattggattagtttattactacttatcactgtatggattttacatatattcaaatggggtatggtagatggtgatccagtactggcaattatctgtgtagtgtttggtctactcggtggtgctgtccataatctgatggtaatttggcaaaccgtacaatatgtattagttccacattttcagagaatgcaccaaagcatcaaataccgcaaacgaggataacatgaataatattgaattatcttttattggtcaattaatggtaatggcgtatacatttatcttctcactgaatgcattcgtgtgcattgggaagtacttccataagcgaccattatcaaatatatatgatgtaatacaaaggagatatagtccagcatatactgtgttgagtacagcattcaattttggttttattctaatgctggttgcattattaacatcgagtttaaattttataacatttggtattatggtatgttcactaacactgagtgtggttattctctgtgcatccgttgagttgatggcgtggatgtattataagatttccgaaatccatgaccgtttaggtaagaggaactaaaatgagttatcgtgaaatattttcgatcattactattattgtttttagtttaggttctttggtgtggttattgtattacttctgtgtaaccccagtatataatatgctaaattcagtacgctctgatgttggtattgtttcttttattatcttcatggcatattatatgctaagtatcacaggtttggttttggttgttatctttgaccttggaccgaatcaagatggcatggaggtgtgggaattgataacgatgtttgcatgtatgatacctgcatttggtgtatgtgctggtgtattttatgggttatgtaaaggtgtgaactacttaaaaaatatccacaatactattcgtaaaaaacgtatgttataataaaaatccagtactattatagtactggattaattttaattatctaagccaccaattacactgaactgtgtggtaacgtctgaactattatctatgtaagttcttcgaccaacataatatagttgtccttttgcttgaataaaagttacggtccctgtattgaatgttataatatcattgtatgtaatgtcaggtggtagtgctgctgataacgcagtaacagcacttaatgcagcactagcactaccatttataccagcagcaatactaccagtaccatagaacttattatctttaccaatgaatacgttggctgatgcttgtgtagctgatgttattgccttaccaatttggaatgcggttcctatggtgtatggtgtgctcctggctgcgtctatgctttgtgtatatccatcccctagctgaccattaactttgtcaccacatgagtatagagtaccattgaggctgtatatgatcccacggttagagaagctaacagcttctgcattagtccatactggtgcggtgtatgagtttacacgactagcggtcgttcctagacctagtataccatatgtgttatcaccacatccaaaccattgtccagaactgttttgatagaacactgaacgttctgttgattccatgcgtacagcatccacagcaccacttttaacgaacgaagtggatgaggatgtagtaccagtacccaatgcaccataagtgtttgtaccaatcgcatagattgatcctagtggtgtcataacacgtatacagttatatcccaattgaactttacattcaaataggttgtcccatatttcaggaacagcagaaaataaatttgtaatttcgaaccatgatgttgtcgaaccagttaatcctatactgcttttgtttcctaaaatgaaaacagttttgtccttcttaattatccatgatgatagaaagcctatctcacagctatgaacatttgattcgatttgggtaatataatacttaacggtgttatcacccataaatgccgcagcaccggatgcaaaaaggtttccagtttgtttatttaaaatgtagttattgtttccatatacactaacatcataagaactttcttgtttttcgttcccataatcaaataacaatacgaaaggtaacatgataaaatctccttgtgttatactttatttaatcattttataatgtacaattttacagagatttaattgaggtactcatgaataaaagaagtaagttctatcaagaatatttcactaaacagaaacgattcacaaaaaaatactttacatcatcccaccgaccagttgcaagttacaaacgtcctaatactaactatcttactggtggcaagtttagtgcaaagttcgaattacttatgcgtgaaaagaatatcaagatgcattacgcagagacaagaaaaaactcatcaattatttgttctgattttcttgagtacggttgcttaacttataaattcaatgatgtatatttgtatattgatgttgattgtaacagtactcgtatgtttgagatttcaattcacccaaatcacaaccgttatataaacattaacttggttgacaaagtactgattggtatatctagtactgatggtggtggatttgaatttattgcttcaaaatatgatgaagatttcgtactttacccagtacttgatgatgtgaaagatattctcaattcattaaaaggaagtcaatacaaattatctgaagaacagctatttcagtactcacttattcatgatgatatcgagatatacttagagtgtgcgagaatcttggagtatctttataatgaactaacaacaactggtaaagtgactgcattcacattatataatatgtaaaagaaaagccagtacatagtactggcattatattaaactggtggagaattatatggctcaaatttataagttgtcgtagcagtaccagcaatggcgttgttagctagtatgtacatagtcctgtagtcgattaccactacagtaatactaccaccaaaagcatagtctgttatgttattagtgttgaatggtaaattagatgaactggtccatgtattagctgttgtgctatttgtaccattggaataacctacactagatgcaccagttgtccataagtttccatcattgaacaaggagacatggttagttgtatatgatttattaggtatagaactatcaattggtgtattccaaactttagtaacccatgttgtaactgctgtattattagtaacgccattacctaatgaaccatttattggtatacctcttatataagaagtgttagtactagggtcaacatatccaaatgtatatgtatcaaatgcaaattgaaaacaatcagaactcggtaatgtgtacagtaatgtatatgaagacgtgtttattgatgaatttgtaccgttcacgccttggtataaaataccactagccaatatttgattattattttttgttatagtgttcattgatggatatgttttcacatcacgcacatcattagtcacatatgtttgtgttgataatgcaacgttactaccattacctataacccctgtatttgcaccactcccataaagtgaaccatcattcaaaagaaccattgtaacattaccatttcccgtaattgttttaatattactaacatccaccgcagcaaatacagttgatgttaaatcagtgaaacgtgtataatgtgatgttgtgccattgattggtgtcgcaaaaccagaatacaatattctattttctttggtaataaggaatgttccagtaacaccatttgaatggatatcaacaatattatctcccattaatacccaatcacttacgaatgttgttgtaccagtacctaacccatgtgtagtgttgtaaccacgtccatacactctaccatcactgagtaatgttaccacacattgaccaccaccaccaaggataactttttggatagtactctttacttttatattcccgtacttaaccattcttgcaaaaggtaacataattccctcctttattcattatactatatttaatcaaaaagaaaagccagtactctgtactggcataatattatttccacggtagaagtgaatctggaactctggttggtacattggttgttgacacacctgtgagatttggaacaccacatgtatataaattatcagcttcatccactagcattgtataagaatatcccctacaaaaactaccaattgcacggccttctaatgcagaaagattcatttcagtaaatgttgttatatttgccacgtttgaaccaacaccacattgaccatttgtattcagaccacataaaaataacttattattatttttaattgtacatgatggccctgcaaggtttgtgccaagttcacccaccaactctatttcaccttggaatgataaatttggaattaatgcactcataggaacttgtgttgtatttccagtaccagcttgtcccctaacgttagttgaagccactttgacggtcccatcattaagaaatatataagaagtttcaattgtattgactgctttagtcgcagtaataatagaagattcttgagtaaatgttagtacgttttgtgctgatgatcctgatacaaatgtattacctgcgtaccaatatgtgccatcattgagcactaatccagtactgcgtattgcacacccagcacttcgaacattttcaatagtactataagtgaattgtgtaacgcttgcagttgaaccatttccaaatacaccacctattcccgctccacagtagaaccactttccattttttaaaaatacacgtaaacaacctgatataacaatattatcaatatcatctgcaataacaccgaagtcagcaaagttctgtgttacttcaacccaaacaccgttggtatctgctgataatattggaattacagaccttgaaccagtgtaccaaatagttccatttttcttaatagcaattgtaccttgaacaccaccccaataacgttccacatttgtattgacattagtccatgaagttgatgtgttagttgagccatatgcaccattaccgctttgtccatatgttgctgtaccataccaatatagatcgcctgtagtgtgtaaataaaatttggaatcagccgagcattgtaatctatttttaaatataggttttggctctggtgctacattcccgaacttaaccattcttgcaaaaggtaacatatttcctcctttattcattatactatatttaatataaaaagaaaagccagtatcaagtactggcatagtattaaggtttaaatatttttataattaatttctacatagttacgttgtgttccagtatatcctggaacattacctaaatttccattacctgcaccaaacagacgttctccgactgcaaaatatgtcccatagaaacaaccatcaaacacaggaacatcattataatttgatatgtaattatccattgaatccattctagtgtatgcagtcagagttacatttgtacctataccatatgcaccataagggttagtaccagcaacataatacccagtgggtgtacatattactggtgaatttgcccctgatctcgtgtggataaatctaaatgtaccttcaggtactggtgcttctttactgaataatgttgtagctactactgggtaatcaataccataactattaccactcaaccacgttttaccatcactatctttgaataatgaacaggattgtgtgcatccgaacagattcaaattggttacatttggaaatttactaatttgtgtatataccagaactgtggttgcggtagcactaccaagttgtccacgaccattatcacccgcactgtacatgtacccatcggtctttaatattatactagcgtttcctaaaatatcaaaatcaacaacatccgtttgtgttaatgtagctataggataacgaaaattcactgtctcaccagtaccaaattgacaattggtgtttaccccacatccatataagttgccgttttgcattaatataaacaaacctgttgtcattttaattttcttaatattaagaatatctatatcttggaatatgtgtgttacatttacaaatgtggttgagttaacagcacttgaaccataataagaaccgttcccgctaccaaagaattcatcgccttttctgtacattgcacatagactgccaccccatacatcatcaactccagtgtcaatttgaataactgaagtaacactagttgttgcaccagtgccaagttcaccacctgaattgaatccaaaaccatacaaatctccactttcggtgagcaccaaaacactgttagtggttgtgcatgaaatctttttgatattattagatggtcttttatttccgtacttaaccattcttgcaaaaggtaacataattcctcctttattcattatactatatttaatcaaaaataaaagccagtatcaagtactggcctatatcttagactgaattgtcaggataatatctcccacgtccccatattattcgcacagcaccaccaccagcagccgtataagaagaattatcccatatactaccaccaccaccatacctcttaccagcaccaccactaccagcaccaccattatatgaaccatcgtagctaccaccaataccattagcaccttgaacaatgataccagtaccaccacccgtaccaatgaacgaggtattatagaatgcaccaccaccaccgcccccgccagcaccattttcaccagtgattgcatttccgttaccacctttacctgtgtagccaccagcaccaccaccaatgactgcaccaccacttaaaccagtgttgccaccattaccaccaccatcattaatagcgttagcagcttttccacctagtccaccaaccgtatatgcaccagtgaagctaacacatagtttttcagttccacgatataaaccgttttcaactgctgtagtagtgttgggatgtgtaagagaaacacttaagtactcaccaccagaaaccggaatattattacgccacgataagccgccaccagcaccacgttgaccacccggcgaaataacacatactgatatttcggtaacgccagcaggaactgtaaattgtgttgttcctattgtcgtgattaattgttcaccatgtggcttatattcaattttattcccgaacttaaccattcttgcaaaaggtaacataattccctcctttattcattatactatatttaaccaaaaagaaaagccagtatcaagtactggcttttacattacaattgtctaggtgtatccagtacatatctatttgtactaggaccaccatcatcataagttccggttgaatatatatttttcatatcagcagttaggaaagtacgtaacgaccctcgatatatttttattttatcatacatagaatatgttatttctgacggcaatggacatgcagtaaatttaccaatggtaacattagaaccaacacccaatgaaccagcataactactcgcatttaaacctgttgcatatacaccagaactcgtaactagtatactagattgtgctgggtatccagtatgaattgaatacaaagtaccgggtggtaaggttgtactattatttcctaatactgctcgtgctgtactagacgtagtgttattaccccatgccccattattggcgttcccacccactaggaactgacgtgctcctgtacttggattctccactaaagcactgactgcaccaattgtacatacaacatattgtaatgtttttgtatatgttgtacttggctgatataaagtatattgattgtatggagtccatgtatcagtagtacttatacctgatgtactaccaccaatatataaattattttgtgtatcataaaacattacacagctatttgttgactgtattcgtgcaatatcaacattaggcgtgacagcttttacaaatgatccatctgttatttgttgagtactaccagtaccatcagcgaattgtctagccccactccaaccagtactccatattgtattattatccattaagaaagtaaaccaagtagtacctgcatacatctgtttaattgaagtacctgaactttgtgtgtacaaattttcaatatattggttataacttaaaaatgatgtagtactagtttctaaaccaatatgaccaccatatccacaataaaaataatttaagtccttatcttgaactaacaaagttccttgtgtcatccagcaatctttgacattttctctaattaatgtccacgaccttactgcattattatttccgcgaccgaacttcccataactattatttcctcgtgcgtatagttgaccgtcagtataaagtacaaccacatcagtatcagttggtattattttcttaattagaagaggttcaggtgtgatattcccataatcaaacaatctaacaaaaggtaacatattttcatcctttattcattatactatatttaaccaaaaagaaaagccagtacttgatactggtgtaatgtcaataagcttcccacggtaagggtgtcttcctaaatccatacctggttgtggtcgcaccatcaccagcaatgtatcgaccgataccacattggtataactctgtactactacatatagcaccaccaatagtaccactactccacagaattatattagaatatgttattggtaaatcactacatttagtatatacaccaacggtagcagccccactaataccaccaaacatacttcggttagcaccagtataatatataccatctggactcataaatgcagaggtgtaagttgtactacaatccactggacttcttatagtattaagatcgcctgggtatgtcctggcaccaaaggtgtatacattaccatcagttgtaataccattacctaactgcccactgttttgtccaccacatgtaagcaacaatgcagaaccagaaacaattgcagtagcattatacgaagtacccatcgcaatagaagcaccagacaatagttttggagtaacaatagctgttgtattaccctggcctaattcaccattgatatttcgtccccatgcgtatatagaagttgtatccaatcgacatagtactgaaccataactaaacgtatatcgcatgtcaattaccgcattaggcaaattaaccttagttgcaacactaataacaccaccagtaacaccactgtttgcgttcatgttacgaccatatgcatataaagaaccatctgaagttttaatatgcatcataccatctgtacaatacaatgcatctatactatccactgcaaccggacccatactggtagttatatcggtccacccaagcgtggtagtactggaaattaagttatttccggcgtatagtattctattattattagtaactacaactgtatatctggcagtaacaccaattaatcgaacatcagtatatatcttagaccacgcacctaatgaattggtgtttgcatccaaaaagcccaactgcccatctgtattgtatccaataccccatacatcacctgcactgtccaataacacttcatgtgaaaatccaatcttaaaatcttttattgtaggaactaccggaactggtgcaatattcccgtacttaaccattcttgcaaaaggtaacatatattttcctcctttattctttatactatatttaatcaaaaaagaaaagccagtatcaagtactggcattatgttattttggtaaatcaattttagtaaagactgcaacatcctcgcttgccccaggaatggcgtaatacgatccagtactatacacatctccatctttggttaatattgatgtcaaaccatcactaaaaagaacatccctaattgcactaacttcaacgggtaattgtaaatttgtagcactatatatagcaccagtttgagaattgtttaatcccaaaccacggttcgccccaacacccttctgatatgtactagtaattaccatttgtgtcgcagtatttaaggcaggtgaattcgtcataaacaacggagaactattcggcaaagtacttacaggaactgcacggaatgtagtcgtacctgaactaagaaagtttggagtttgaccacatacgaaatatgatgtgccattatagtaatttaatgcattaccaccaattgctgcatcgattacaccagaactacgtaatccccaagtgttaacttgtgtttggctccccgtgccatgctgcccactgctattccatccagaactatatagcttattatctaatgtaagatacatactatcattcgcattggtcattactttacgaacgttcgtagcacattgagttaatgtgtaaattgatgatgaaccaatacctaaagaaccacgatatccattatctcctgcaccatagagtactgaattagtgctaagtacaaatattaaaccatttgtacatacaatattagcaatttcacttactggtattgcatttgtgaaccaactggttctatcaactaatacagtactgtaagaagtagttgtggaagatgtgaaccagtacgtttgacctgatgaccatatcgtattatcatttttaataataacaagtgtacgatcacccacgaaaaaattagaaacatctgtacttactaatatccatgaggatactgtgttggtatttccatttccagattcaccaccttgatttctacctatgtaatataaatcatgtgaatctgtcaataagaattgaccctgtgtggaagcaccaactttaattatatttttaggaccaggtgtgatattcccataatcaaacaatctaacaaaaggtaacatatttctctccttaatttagtaatgcccctggcaaatccactttgacgaattgtgcatatgctgaggaattttgatcaaagtttggtcccaatccataaaatgagctaatgccgtcttcatttgtgtatatgatataaacgttctttacatcatttccgcatataaatcgaatgtctttcgtttgtgttcccgctggaacattacgaaggttcacaacgccattacttgcattgttatcagccgatgcaattggtaattgattttgaccatattgaccacgcatattttttgcatctaaaccaaacacagtatctgataccgcaccaactttcaaaaatgaaccaaaactattattgaatgactttggaaatgtaccactataaacacttctcccatctgataataccgctgaactgaatttcccgctattcgatatggcaaattcattgtaaggaagtgtacccattttggtatatacagaatatgaattagtggaagtattatcaataatcttattaccattatatccaacaccatactggtatccgtctgcatcttgaactatacacaaaggaccacttggggtttgtgtcaacgaaacaacacgttcaacttgtatatcaccaaatgtatttcttcgccatgttctatctattatagtactagtattacccaaagataatgccacactatataatagattgttttcagtaaaaatggcaacataatatgcgtggttaataacttgcttcatcccagcatcaataacttcctgtggaatatgatcagtaacatccaaccaatcaaggttagatgatgcaatatctggagtactgaatttgtcaaatctagttgagccacaaactagcactctatcatcatttgtcaaagccactgtgctagtctgcatattagaactgaatgatttaacattactaatgttagacttgtaccaacccttatcagcagcacccaccgtgaatccggttcccattgatccacttgtacttgtaccataagcccacatctcaccactatatgttagtgccatacagtggcttccatttgcttggaaatcctttataccagttggagcaaccactgtattcccataatcaaacattctaacaaaaggtaacataactaaaatctccatataataattataatgtatttacaaaaaaataccagtacgtatttcagtactggtatcatttatggtaaaatgatagattgtaacgaactcatacccaatgctggaacactagcctgtggtgctggagaattcaattttggtgatgaaaccgcataagtcattcctgtacccaaatctggatcaaaaactacagcacaataattcccactatatataagtccattcttgtatccttgtgcactttgaatgcatttcgtgaacgtaccaatatctgtagtggcatttattaagttcctcccacgataaccgcaggtgtatatgaaattatcatcgcctatgtacatactagaatccccagaagaactacatagatacgacatataagcacgcatgtttttaggagcaactgacaatgtacctgcatagaatttattattcgaacccgtaatatcaccatcacccaatgcaccaaaacttccccagccagtaccgtaatatctcttatcactcaaaaatataatacagttgttattacacatcttgatttgatatatcaatgaaggatcaaccccagggaatgattcagtgaatgttagaacagccggatcagtactagcattacattgatgatatgtattagtaccagcggacaagattgttccattagctaacagaattctcgcagtaccagtaccagcagtacaagcaactgcacttcctgcacttccggtgtatatttgtctgaaagtaaagaaaccaacagtcttactcccttgtccactccaaccagtattatcaacaccacacgcccatactgaaccatcttccatgatcatcattacaccaaagcgttctattgaaatataaacaatctttttagtatcaactgcacgaaatctagaagttatatccgtccaaacctttacacttaccgaagtcgcactggaagtaggatcttcccctgctatcattatcctaccattgttagtcagatacattgtctgactataaccagtactacaaaacttaacactatcagtctctggaacctttaaccactcgttgtaacgtgttacgttagtgttattacctaactgataatagttattcatcccagatacatataacacaccatcctttattaaactataagtcgcactatagtcactacaggtataacgtgtacccacaggtcgctcaacgacgttcccataatcaaacattctaacaaaaggtaacatgattttctcctatgattgccataactgcgttggcattaatgttaatgttttaattaagtaagtaccatccggtaagttaccacctgaaccgttaaagcccccacatgcatataatttataatctttagttataattattgttctggaccagtctttggatgccataagaacattgtcatatccaccctgtatcgcacttaaagaaaacgccccccacgaagtaattactgttgtatttcccgtcccttcttgaccatatgtattgatgcctgcactcctgacatatgatgggtattgagcaataggtgcaccaattgttgagttacccatattactaggacacaggaaaccatcactaatattcactataacctgtgaattctgaactgtagttaattggtttgtagttgaagtagtaccattcccagcttgtccagaattgtttctaccactccagtacaccctaccggcagtgaaccaccaggtaacatcataagtagcacttatataatcgacgttggttcgtattaatttattagtaaaaacgtatgagctagtcccaccaccactttcaccaaagttatccttaccacaaaaccatgcttctttatttgttttgagatagtgcgtaccctgtaatgaacacgccaattgagaaacttcacccataccagtaacaactgttagtactggaatgggattttggttacctgttccacattcggcatttgcatttttaccacaaacaacgactcttccatcgtgtagtaatattctagtactttcacctatatgtacactcttgattaaattagcgtgtatatttattttgttaaatgcggcagtaacatcagtccatgttctaaaataaccattaactggagttgcatctccataatcggggaatgctactgtattccctgtgaaatatattctattatccaagtcaatcatcaatgagccatgaacgcctaaccaaaaggctgcacagtgcgttgccagtattgtaaaagtagaaactgtcgattgattccctagacctaattggctcaagttattaccaccataaccgtatagtgtattcgtgggcttatgtagatacatagcattagtataatgttgctgtaaaacatcagtgaactcaactggatcaggaataggcagtttattcccgtatttaaccattcttgcaaaaggtaacatattccctcctttattcattatactatatttaatcaaaaagaaaagccagtactcatttaattttaacgaggtataactatttttttgaataatccagtatttcctgcattttcttcttcatatggaattgtacccataccagcagttctgccaccattccctgaaccatacagttctccattcttaatcatgaatgttatcatataaccatgtgtcattttatcatatggaactggttcagttatattattacatgctcgccatgtactaataacacgagagttcgttataccatcacctgatgcgtttcctcgaccagcgaaataccatatcccacctgctctaacgtgtgcttcataattagaaccacctatgtaatcaatcgcagtactaggaatactagaagctggtatctttgtgattgttctaagactgttaatagtgccatcagttccatcacccaactgtccatctatttgtgaaccgaatacatatagcccatcactctttaatacgtaattagcactatatgcattttctgaatttatctgtaatactccagtagtaacagtagtcaatgtggtagttgtactagtcgtaccagtcgaaccaatactagatttattcccactgtactttaatgtcccatcattgtataatacaaatgaagcattattcgcggttacaccaatatctttaacatcaacttcaggtgtcaatgtcagtactgatactctttgtccaacagccccagtaaaaacttcaccgttgttattgtcacccatcttatataatttattatctattgttaataataatgtaacgccgtttcctataactattttactatatgtgtcattcacattattaaaaataccaagtatttctgtccatacacgataagtagtattaacaccacgatagatttgagtaccagtactccaccatgtgccatcatttttacgtactaatattccttgtgtatcaccagtagtccaaaattcctttacatcagttaaacataaaacccactcttcaactatagtaggagaactactaccagtacctaattgatagtaaaaattatgccctctgccatataatcttccgtcttctaataaaataaacacattattctgtaaaacttttaccatctttataccaactggcacaggtgcttcattcccataatcgaacattctaacaaaaggtaacatattccctcctttattcattatactatatttaatcaaaaataaaagccagtacagagtactggcattgtgttatagttgtttccacggcaaaagtgaatcatcaactctagtaggaatattagtactaacaacagtagataaactcggaagaccacatgtgtataaattattatcttcatcgattatgaatgtgcatgactgatctctaacaaaacctttcacagaacgaccctctaaattactaagatccatttcggtaaacgttgttacgtatggatcatttgaaccaacaccacactgcccactggtattcgatccgcactgatacaatttattattgttgaaaacaacacatgatgcccccgcactattggttgctgacccaacagctttagttggtccagggaaattaacattaggtactacagtactcattggtactgggtttctattacctacacctgcatcacctttcccgttaagtgaaccaacttccattgaaccatcacccaaaaatatataagaactctgataagtattagatgacattatagcgttagaaatggatgtatcttgtgtcattgttgtaatactcgttccagtgctgccagttattaatgtgtatccagcgtaccaatatgtaccatcaccacgcactagcccagtactgttataggaacaactaatatcaataacattatctattgtactatacgtaaaattattgacacttgccgcactaccatatccgaacatcccagcttggttaccaccacagtagaaccatttgccattatttaacaatacaacaataccagatgaaatgaagacttttttgatatcttcaggactaacaccaaaatctgtaaagtactgtgttacattaacccatacaccattagtattagcaccaatctgtggtagtggatagtttgtgccagtataccaaatagaaccatcattcttgatggcaagtgttccgtgcaccccacaccagtaacgttctacgttggtattgacgtgcagccatgtggttgacccatctaatgaaccattcccgccttggcctagtgatccagtaccgtaccagtataaattaccgttcgtatgtaaataataacgtgctccataattcgattgcaacctactttcaaattcaggcttagggtcaggtgctacattcccataatcaaacattcttacaaaaggtaacatatttccctcctttattcattataatatatttaatacaaaaaagaaaagccagtatcaagtactggcatattaatttactgcacaaatgacatatcgacttcggtataattaagaacgttctgtccagcactaccacccattactacaaatgaagcacccgaataatataacttcgaagtgtcagtgagtataagtgaaccagatggagtgcgtaccaaattacaagaggtattaaacgaagtatatgaaggagtataggagtactgattattattattaccaacacctaattgcccaaacccattcgttccagaagcatatagaacttcatctgctttgacaatatgtgatgccatgttaccaacacaagtatatagagtataaactcctgaactcaataatgtcggagttttatattgtatatctgtagatgtagaagtaccacctgtaccaaattcgttcccatattgtgcaccgaactgtttaccacaagcgtacaaattattatccgatttgataaaaaatgtactctgataacttacattaaaatctataacatccgaagaaatcatcgtcaccccagtaatagaagtttgattacccgtgcccaactggtagtaatagttaaaaccacaaccccataaagtattatcttcttttaggtatatgttaccaactgcctttttaaccgaagttatagtatctatccttttgaatgtgttaaaagaattaatgtttgtaccatcaccaaatgatgataggttcgagttattgttcgctccacaacaatacaatgtaccatcgtttgttatcaaatttaccttcatatcataaaaactactcatgtactttatatcagaaacattaataccacctgatgttatccacgtagtacagtccgtccacaaagtttttctatcagttacaccagtgaatgccttcgtgttaccagtgataaaaacttttccagtacctttctcttcatacaattgacaatcactactgttatcttccaatagaactcgtttaacattctctgcacaaagaataaatttactcgatgctacacctgttccagtaccccaattcgtcgaagaagatgcatacaacttatcagtataagtatcatgaagatacatagaatcactggaatatattttaaaacgcccttctttctcaggtataatattcccataatcaaacattctaacaaaaggtaacatatttccctccttattcattatatcatatttacctcctaaagaaaatccttgacaccctttcaatactagtgtactatagaaggaatataaggagaactgtacatgacaactacacttaagtactacctcaatactctaaatgaactagagtacgcgaagtttctcgcggatagttcgtggctaattgagctaaaaacacataacagtactggatgtaaccttatgctgaacaatgcacttgatacccttgtagtgagtattttacacagcaacatctgcggggatagaaacaaacaattatcaaaaatcttagtactggtggctctatgaacactatgaacattgaacagtactacatcgatgcactaccaacaaaaggtctacgagaaagcctactgtatacacaaaataattttatacactacaaacgttatcctaaactcctgaactcgtacaggaataataaaataagaaatgctttacaaggggtagaaagtatgcaatactattacatccttacccttttaatcgagtactaatatgtataaagaattctactgtagtaagctgcacaagcaataccgagattcattccccaatgaacctatggacatgaatagtccattttataattttgacttcagactggagacacgttatgcaatagaacatcaatttcctgaaactaagtacttagctatcatgaacctcatctttaagttctaaaagagtactatatgaaaactatgaacattcatcagtactacttagatattctccctaaagatgtacagttcatccttaaacaagaatacagtactttaaaaaaccttaaaagaaccgcaccgaatgtattaatcctgcaccaagaaaatgtagttgataatattctacaaggtgtaccagggaccgagtactttaacataataaggctaattacattaccatgaatcatatattatactattaccaaaatctatccgacagggacaagtacacccacaactccaatgtatggtactacaaacgcggtagtataagagacaaacaacattacttctgtattgctataaaagaagcactaacaactaagtacacgtacagagcagtactgaaacttattgatatgtaaagagaatactatgagcattgaattgtacttaagtaaattacagcctggcgatagattcatctacaataagttcgaattcaactacaagaacgggagcaacaaatatcgtcgaggatacctatatacaagcacaagagatgcacaaaacgaaaagtacacatacagagaagtacttaaactaatctctatttgaggtaatatatgaatacatttgagtactatacaaataaactatctatgcctgaaagatctcatctctatgtgtggagaaatgcgtataaaagcggcaataaacttatacaaagaaattcccttacagtgtgtacaaatttaattaaagcagagtaccgcacatatattgaagtactgaaactgatagcaatctaaggtactctatgcaagaattctatatctataaactccagcacaaagatagatacaactataataaattccaaaggtactacacagtcgggaacaaaagagataaaaaacgatacctactatcatgtacagtagaagcacaaaacgaaaagtacacgtacagagaagtacttaaactaatcttaatctaaggtagacatgaacacttttgagtactacttcaataaactaaaccacatagaacaaagtatgcacaactcatttattcagcaccatcaatcatctgcacatggaattaaaaatatatcgattgagattatcactacccgtgtacagtcatctgaacgttatatgtatattgatgtactgaaactcatctctatgtaaggaataatatgcaagaatactatatagaacacataagcattaaagaccgtttcatgtacgacaccttcgtgaagtactacaacctggcaactaacagtactaaaaatattaatctcaatagctgcattcatcacgcactaacaaaagataatcccttcagggaaatcctcgctctcgcatctgtataaaggaaaccaaatgaaacttaatgcacacagcaaacaataccttaagcactttaagtacctcaacagtattcaagcagaatcttttacaccagcatatacgtatcaccctaatgtactaaagaaacgaaataaaaagaaaaaatccagaaatgttctcgtatctaagaacctcaaatcgtacttgaagaaaaataatatagctcttgcttttattaatatctataatactgatttaaaagtattgagtactaataccagcacaaaagcactaaagaatgcatctatctatatacacatggataatatcccgtgcactataattctatctttcgggaatgtatacttcttcgggaattgtaatagcacccatgatatcagtactgcacaattccaaatcggcgatatgtactgcatgggttcagaaaaaatacacgataacatgcacttcttccaaaagcaacgtactaacgaaactgatacagtactgcaattcctcaaagaattaccaggcaaagaattatcagaagaagatctattcatgtacagtactgtaatagataatccagaactctataaaaacgcgtacaaactaacaaaacatgtacaggaacttatcagtactgataagaaatttcatcacctcattacgtatatttcaaactatgtataaagaatactacaaagataaactcccaatgcatctacaacaccttgtaccaacagaacctataggcataaaaaatcatgccaagataatgttccaacaatgtactaagtacacgctcatagacgatgataatccatatatgctgtactacatcgtcgccctaatatacaggtactaatatgcataaagaatactacacacaatttctccccagcatttttgaacactacgccagatacaaagtccccctggataacgatttggcagtactgggattcaataactgcatagaacgaagtatagaaaatagtagtagttatgaccaattatataacactatcctacttatattcaggtactaatatgaataaccacaaagaatactacaaagataaactcccaatgcatctccaacaccatataccaaacgttgcattgggcataaaagatgacgcaaaaacaatgttccaggaatgtactaagtacaccctaatgttcgaggatagaacatataaactgtattacatcctcgccctaatattcaagtactaaagaggccaatatgaacgaacagaaagaattctacaccaaatacctcagcaacgaagaacaaatgtttctaaggagtgtatcacctttaagtttagatacacaacacgccagatattgctttaataattgtatacgtagtactctagacgcattagaatacaataacaaaaatattatgtactcaggtgtaataggactaatattcttctatgaataactataaagaattctacttaagccatctggatctaaactcccaaatgcttataccacaaatcccaatagatatcaaggataagaaaaataccgaacagttcatttatcatacacagtgtgctatcaccccaaattacattccatatgaattgtactacattctcgccctaatatataggtactaatatgcatagagaatactataaacaatttgttaaagggaactacaaacacgccgtacccagaacccctttaaattctaatgacccaagtactatattcttgtttaatgacgcaatacgtacagtactcaatactaaagatgaacaagtgcagtacgtattcttactattacttatatacagacactaactaatatgaataaagaacataaagacttctatataagaaaactaacattcgtccccgtaaaaatatataaagaatgcgacccaagattatacctatggcacttcaatgagtgcataaaagattctatataccctaagaactataaagaacaattgtgctcagtactaacactagtactatcatattaatagagataatactatgcataaagagtataaagacttctatataagtaaactaaaagaaaatgaacaaatatggattaacaatctaatccccctaccaatgactcaatacgaatttaatatatgtacagagattgttttaactagtaataatatctataatacgtactacttcctattaagagtactatatggtactttgaaataataaggtatactatgcagaacataaaaaactataaagagtactatataagtaaactaccaccgactgaccaagcatggattagatctataatagtactggcatttaatagatatgcatttaacagatgtaccgagattgctatagacccttataatattaaagagaatgtacagcataatcagtactactatatgttaatgcttatatataggaagtaattcaacatatagacaggggaagctccgcagggaaagcattggacaggctttaacatatgttatatatgttaaaattcagcctgctcgacgtctgaattgttaaaattcagcctggacaaatgcgatcactaggattctccccaggctaaaccccgtaatcatatgtagtcataagtaatcatatataaacatttaagtaatcatttataatcactgtagtgatcagtagtgatcagtagtgatcagtagtgatcagtagtgagtactagagtgtaatagagtacaggaatgttcacgtttaatcaagaacgtagcagtactgccccaaaagtattcagtactgaaggtgtcgatatcccactaagtaggcagaggaagtctgccgtactttttagtttccaagctccttttccatttttcaaattacatcaaatgtaatcaaaagtaatcacgcaatgattagtactgaattattactttcaccttaatttcaattacccctttacccttcggggtaaaattccattaccccttgaggctccagcaaaaagttggttagtactccatcctaaatctcgatcctaaaaattttggagtacctatgaaataaaagttggatcatcgaaagttgaaatttacgttgggacgtttatgatttgtgggatataatgatgtttgtagtcgggtagttctcaagaatatcagtactgaaagatgaaagaaagttattgactttatgattcagtactgtataatgttctacatagagagatgagttgctgcgaacaattcatttactctacctcctgtcgtgagacagtacagaaaagatagttcctcctgtggtggtacatctttttgaacctcatatgaaaatcgtaataacagtactgatattaacagaatggtgtcagtactgattttaatctaaagcattatgccaccagcttgtgctggtggattccctctaacagtattcagtactacatgatggtcttcatcctcctagggtaacatagtgagggctatgatggcagtactgaatactccctatcaaaagatagatctatggtatagtactgacggattttgggtgtagttaccctggatggattttggacgtagatatgtctagccctccagaagtctggaagtaaagatggctatccatctagacggctaaacggctagatttctggatggctggatggctagacgtttggacggctagatggttacacgtctggaagtatagacggctaaatcaaaattttattttgttttttccaatagttcccctaccgcgtggggatagtttccccgcagtatctggagttagatttttctgaatctggaatcattatcttataaactgggggcaatgtcaacggcctggacggatatttttaaaaattttttcagtactgaattttgggcgtaactatgcacccggtgggcttgagtctttctcgacttgatggaactattatacagtactggaaaaataaagcaataccctggaagcaaaaaagttttaattaatttgcttgctatcctgggccggactatggtactatatttcagtactgagaaagtgcgttgacctgctagggtgcgggagtgtatcctttttttatatcttgaattttgggcgtaattccgcaccctctggggtttccgctttctcgcgtctatgtagtaattatacgctttttcaggatcaagtcaatacctaaaaacaaaataattgaaaataatttaacgcgtttaaacggcccgtaaagccctggaatgattggaatggtgcaaatgtatagcttaggtgtattaatgcgttagaatgcgtctgaggccgttttatggggtgtagtagtgatttggttgattcagtactgaatgatagtactgaatgatagttcccctatatagaaagaaaactattttaaaagtatttgtagaaagtacttgcatactatgtttaacggcgtataatgttttacatcgagagcgggaacacttcccgctacactttaagagagattaatacgatggcgacccaaatcaataaaattattgctaacctggtcaacttccgtgaagagatgaaaggtcttccggctgaaacggtaaaaattcacatttcagcttatcgggaacttattacaatgttgccgcttaagcgtgaacaatacgccgctaccgtgatgcttgatgcgatgatccataagatgatcgccagtgatttgacgatggtttatcagtatatgggcgaaaatttcgcggtgtatagtaaaccagtaccaggaatggaaagtacagaagtattacacggtttaaatttaaaacaagatgcatgggataatatgcctcgtttcctggtatgggctgacagtggcaaaatttacgaataagttttagaaagtacttgcatactaagtttaaaagcgtataatactttctatcaggtggggaatagttccccactataattaagagattaattttatgagtactatcttaactgtttctcaatccgttgccctggctgaattgatggaagctctgagccgttgcactgaggcgggcttgtttgatgtggttgacgttgctcccgatgttatcaataatttttgtgatgaaatggcagaatgccaggacaatgatcgccgtttgatgcaggtgacatttgaggaagtacagccgggtgagatcaaaggtttaccagtactgaaaaaatagtacttgcaaactaagtttaaaagcgtataatactttacatcgaggcgggggaatggttccccgctcaatcaaacgaggatttaaaaatggctaaatcaaaaatgttcttaggtcacgctaacaaaactcaatggaatgtaagcctttggattaataacgatgaggcattgtatcggctggcgaaagaatttatcgacgctaataataatcgtaatgatgcggcccgtcatatgatgctatttttagaacagactggacaagataaaactccagacggctttaagtatagcactactgcgatccgtgcggcaatggttggaatgtaatagaatagaatttatttaaagtactattgcacggggatagtactttataatagtgttttattcatacaccaacgataagggtaacagcatgaatattaagtattttgcgacgcgtgaacaagctcggatcgccgctcgccaggtcggggcaacgtttaaagatatgggtgcgggatcggcaagtggtgaacgttgggccattgtaaagcgtagtacagccagatcattacagtactggttagcggccttaaaaagtcctgatagtgtatcgcgacgagtggtagaaataaagctcgaccgaaagggcaaccgcgtgaccgtgtaccgtactaaaaagattgcagtacttgaataaaaagtacttgcaaactatgtttaatggcgtataatgttttacatcgagagcgggaacacttcccgcctataacctggagtaataaaaatgactaatatgtatatgactgaagttaaaaccgtaaaagatactaccacgaataaaactacttacttacagcggatctgcggtgtatggcaacgtatcagcaaatcaaagtactttaaattaacatcatatgcaaaccgttcggattcattcagtactgaaataaaaggtaataaagtacaccaatacggcacttattattattatagcctggatgcgattgcagtataagcagtttacaaatctttacaattgccggtattgacttattttgtcagtactggcataatgtattcattggcagataagccgtagcccatagggtgcgggagtgtatctatagaaaaagtagtttattacagttacaattgtgcacccggtgggttagctgttgtcatggggtatattatgccagtacttgataatgctgtcaatacttttttttactattcagtactgaaaactatttttaaaaagtacttgcaaactatgtttaaaggcgtataatgttttacatcaggacggggaacgaaataagtaacttcccgttaagtagcccaggagtaagacacacgaaaaactcccctgataaaatagtttgacaaatgtttttaaaagcgtataatacttacatcaactactgaatgagagttacaaaatgaaaactatcactactactactttcgttatggatttttctgaattgaacgcagaacaaaaaacgtcagctatcgaactggttcgggaacgtgaaaaaaacttaaacgatgattatttttctgaaagtgaaattgaatactataaagaaacagtactaccggaatatggcattaatgacgctgaaatacaattcagtggtttttggtcccagggtgacggtgcatcaatcagtactgaccacgttgacgcagtgaagtttttacgcaaggtaagagcattaactaagtatcgctcaatccgtcacctgctgaatgaagatgatttggcaatgagtgtaaagcgttctcactcccactactcgcatgagaatactgtaagcgggtacattgaatcggcttacactgatttaaccgcaaaacaagaaacgttagttaatgagcttgaggaactactcactgaaactattcgtgaattatcccgcaagttgtaccgtgatttagagaatgcatatgaggatcaattcactactgaaaacatcgtagcactgattgagggtaacgaatatcaattcaatgttattgatggcgtagtagaatcaatcgaatattaattcaaaaagtacttgcatactaagtttaaaggcgtataatactttatatcgaggcggggaatggttcccgcctatatcccaggagtaagagaaatgatcgaacaaatcaaaactacaacgccaaacgtaacgggtacagtatcacacttcattggtgacgattcgcggggcgttccttattgtgcagtacatgtaaaccagaagggcgactactggctaacggtttacggttcttattcttttgggcgtagtgcacaccaaaagatcctggataaagtacagccaacgggtaaaaatattaccgctgaaatgttttataaaaagcactaaaaagtaattagattaacgtataatactttatatcgagagcgggaatagttcccgcctttactgagggttatctaatgagcaaagtaattaactatacagtgttaagcaagtcattgtctattagccaatgtactgatggttattggctttatgatgaaacacgcggcatgaatttagctatgcaggagaaaactactgatgcggcatatcttaaagcactggaatactaccagaagcgtttaaaggaagtagaaaacgattataataacctgaaagcgaaagtagatcatttcgtcggtgaagtgacagaagatgaggaagatgatcactactgcgaccgttgcggatcttacaattgagtactaaggattatataatgagtgatttaattgaacgtatcaaagagcttgaagaaaaagaattgcagttgatcgggttacggaataaagtattccatgatttaggtggctttattaatgcctgggatagtggcgatcctgatgcgttacctgctaaccgccaggcgatgatcaatgatgtgcgtggtgtctttgagtatgttttaaagcaattaaattaaaaaagtacttgcaattagttttcagtactgtataattgtttacatcaagggggaaatggttctccctggtaatgaggaaaataaaatggctaatatcactactctttcccaacttgaagcactggttaaatctatgcgggaacatgccgacaatatcggcgtaaaagatccagccgtttgcttctgcgacgatgtaaatgatgatacactggtaatagcagaagtccagaacgtttctaactattcatcgcgttacactggcggcgtagcaaataaaggtgacttctgtttataccttacaaaataacaacgcggggagataataactccccgttactttttcagtactgaatcatttaatagacggatctatgcacccggtgggttggagactgtttcgtcttgatgtagtaattataccagtactggatgcacttgtcaataactaatttcaattttttgacacaatatgtagtgtctgtttactgcatttgttgcactggataccacaatatatagtggtgattttttctatagggtaaagtacttgcaaaattatcaaaaagtatcaaaacagtgaaattagtacttgaaattagttttcagtactgtataatcttttacatcgacacgggaaaacggtttcccctggtaactaaggataatcaaatgaaagtagcaatcatcgccctggctttatctgtttcctctttcgctgttaacgcttccgttgatgtaccgaaagaaaaattcattcagtgcactgttgcaatgactaacgaggaaacggctgagatcgttaccaaatccctggaactggcccctgcaatgtttgctaatggcccgtaccatgaagaagatgatcagggtagcacgaccatctattacgatgcaaaaagtaaacgcggttctgtcactgtaatggatacggagaaagttacattcactggcgtaattaattgtttataatatagtactgaatcactagcccactataaacagtgggctttttttattgtagtactggaatactttgaaaatagttttgaaatagtagttgacattaccagggaaaagcgtagaatgtattacatcaggacggggaacactaagtagaccgccagtaagtcgaacgaaaaactggacacgacctggaaactttgataaactaacttacacaatattaattgaggaataaaaaaatggctaacgtaaaatctttctttaaagcactggtatcttctgacgtatctatcgcggctgaattgctggctgacctggataatgataccatgaaagcagtacgcaacaattttaatatggcatacagtgccgcgaaagaactgcaagccaaaaaggtagcagaactggaagcggaaaaggctgaacgtgaagcagaactacaggcaacaattgaaagcatccaggcggcggtcagtggtttagatatcgagattgtaaccgatatggcacataaagccctggctgcaaaatacggtgaagtaaaagcggttaaagaaaagaaatggattcaggatcgcgttaatgtagtactggataacggggaagaatatctgattccggtgcgtggtaactgcattgccgtagtactggatgctatcaaagaaagcggattgacacgcgaggaatggatcgaagctcaccgcaaagttgaagcataacaataaaagtactgaatcactagcccaccttaaacagtgggcttttttgtgtctatagtattccagtccactagcaccgcctagaatcgattctaacgcattaaactgattatctaatgcatcgctatagctggtggagttaaggccgttagaatgcgattgagagcgtttaaagtattttgcaaaaagtaataaaaagtacttgcacgattaagagaaaggcgtataattagttacatcaaggcgtgacaccttaactaactgaggatttaaagatgaatacttatgaactggattgtttcactatgcaagtgatgttagtatgcagtaaaaaagaatggtcatcaaaggaatttaaagcagttattgcatgttcaaagaatggtaaaagtatcaatgaaacggcatcaatcattgataaactttaaaaaatagtttgacaatagttttaagtactgtataatattttacatcaactactgagaaggatttaaaaaatggctatcatcatcacttacgtttctggcaatactggcacttctagcactgttgcagtactgaccaacaagaaaggttcggagcttcattctgcaatgaacacctgggcggtgaatgagttcggtcagtatgctagtgtagcatacattgaaacctatcaagtgccatcgattagtttaacggatcttggcgtggatcgtatcttgtgcctggatgaattaaattaaaaaagtacttgcaaagtaaatcagataaagtataatacattacatcaaggggagaaatgattctccccactataaggaaactaatatgaaaacttgtcaatgtggtaaaaaatctattactggtttgaagcggggcgttgctctttgtcagtatcactataacgctcaagtatggggtaaagagtgggccgaccaggtggaagctgtaaagaaagcaaaaagtaagtaaaattattatcacagtactattgacatagtttgatagtactggcataatagattttatcaagacaactgaggaaaataaaatggctatcatcactaaaatcaaagtaagtaaaaccctggttaaacttgaacaagtgaaagcaggttataaagtatcttggtgcggtatgtatcggatgttcgcagatattgatgaagcaatcaattattacagcgacacggttaaaaactttgttcgtgctgatgtggttatggcagtggcaacgcacaaagcagcgaaagaaagtaagtaaaaatattatcacagtactattgacatagtttgatagtactggcataatagattttatcaagacgacacatattaatttaaggaatactaaaatggctaaaactatcattaacaccgtttccctggctgcaatccgtgcaatcaatgttgacggtaaacgttggactgattcatatggcaatacttatcattcttgtcatgtaagcgtcgaactggataacggtttgaatgatctggcggttgaatcatttacttatggctatgaagatgcatatcaacaaacggcgttatctctcttaaaggaatcagtagacgggcttaatactgatgaaacctcccttactcgtttatgcaatgatcttgatatcccgttgcattgtactgtacagaatgttaaacgcaaaaaagatctttaattagctttactttatgcagatactttgatatagtgtctgcataggggaaagaaattaaattaacttaagaggatcgtataatgaaaaatatcagtactttaatcgacgcaggtacacatgttcggcggtctatggttgcaaccagtactacaaaacaagtagcgagcggttatcttgtatttgtgcacgatggtaaactcctggaacgttcaatcaattttgatgttaaaaacaattgccgttttattatctttaagcgtgaacaatataaaattgatttaccagcaaagcccataagcggggcgtacaacgtgcaatcattgtttgaacgtcaaccatacacctattaatcaaaacatcgttagcggtcgatttaggccgcttatattggggattataccatgaacgttaatcaagtactgaatgaaattgaaagcatcattaagccgatgaagcgtactgatgctatgttaacaccggaagaatgccgcctttatgagcgttacagcgtcgaacaagtccaggcaatggctatggctaccccagcagttaaaccgcctgagaatgcgttacaggacgttacaggggattatatcatcaatccagtactagggaagatggctgcaatcaccgaagatcaacaagactacttaagccagtacttaaaaggttaattaatatgcttactgtacaggataagatcgacatcttaaaggttaatatgtatgtgattgatgcagtacctggtaaagtatttgcatacgatgatagtactgtaagcgatttctactatagccaggacgtgggggatctttctgtacagtcggttattgaaaacgtagttaatgcagcgtatgagcatttactttcaaatagtacttgcaattagtttttaaacgcgtataatgttttacatgaaggggagaaatgattctccccactaattaaggaatatgaaatgaaagcatcaaaaaagagtaatactaagaaagcacgttcacctttcgctggggtattccctttacgtttcgttgatgaagtagtttcctacccgccgggccttactcctgagatggtagaaagtttgcgtaaatctaaaaaatagtacttgcaattagtttttagtactgtataatagtttacatgaaggggaaaacgttccccttacacctaacgaggaaagtataatggaaacaattttaatcaaagacactgctactactgtaacttatgataatgattgcattatcccagggactgagtacggcgaacgtgtacccgttcaagtagagattgataccacatacatcgacaaggctgaccagtgtatcactattgtaattggtgaatatcgttttctaccagaagagatccaaaaatggcagaatatgattgaccgtgcgaaattagtcgcacaaagtttaaaatacaaagtttaaaataatacttgcaattagtttttaaacgcgtataatgttttacatgaaggggagaaatgattctccccaataacaggagaatcaaaatgaaacaatacaacgctcggtttgatgttactatcggtaacggcaaaggtcaattctctttcagtactcgcaaaagttatacagaaaacttcctgcgtaattgtgcactgaccgccgcacaaattaaacattactttcaggctaaaaaatgaaatcattagcttactatagttcggccctggtcggtgcattgatcgcggcattgttagtaacctatctattctttatggtgatttaaatgaatccaacaggtttaaactataaaagttgttcggcatttacgaaagcaaataaagcgaatgcacgtaaagcgaaagtacaagaatacatcaagcaaggcatgacgcgaaaggcggcgattctaaaagctaaaaataaatgaaaaaagtggttgactccggtcagccattttgctattatatattcattgagagatagctcactagcccacagggtgcataagtgtatctattatataagtattgagtactgaaaactattttaaaaaagtacttgcaaactatctcaataagcgtataatgttttacatcgaaaggggaaacggtttcccctggtaataaggaaacaaatcatgactatctcaattgctcaatctaactttgaaaatgaaatcatcgcccaggcattgcgtttaaatgatggtcgggccgaaattaattacggtttcaattcaggcggttgtgaaaaatatcagtactttgtaacggctgatggcggtgtcctgggtatcaatacagttattgtaaacatccaaaaaattaatttcaatgatccagacgatagccagttttacatcactggcgtagacgtgaactatgaggatgactcactaactgatgatcacactggcgagcggttagaaagtgcatacggtgaagatgattatcagtccggtccagaagatttcgaataatataaaaaaaaatagtttgacaatagattatagtactgtataatagtttacatcaaggggagaaatgattctccccactaacagagagaaaacaaaatggctaatatctgcactgtactgaaaaatgcaaaacaagttttattttctgatcacgatcatttaaacaaggatattactggcgttcggaatatcaaagatgtaaaaagtgttatgggtatctattgcaatatgaaacgtgttggaacgttcggcgacaaagtactataccaggcaggggattacaattttacactgactatcattaactaaaaatattatcacagtactattgacatagtttgatagtactggcataataagttttatcaactacactactaaggaattaaaaaaatggctatcatcgcaaaaactgaaatcgttggtctggattctatcatcatgacgtttgaagatcaaaaaggtatgtatgtagtttcatatggtgattatgttcgggagtatgaaacggtagacgaagcctttgaaagttatattcgccaggtgaataaagcatacgacgactaccgctaaaatatattaccagtactattgacaacgtttgatagtactgtataataagttttataaacagtagttaacttaacctaagagagaaataaaatgatcgcactggattcattcatcgacgcagtactggcaaaaactggcgaggatctgaccgcagaacaatacgcaatgatcgagcaatgccagcaagacggtaaatcggtgaaagatactgttaagattatccgcaagatgtaagattatagcccactagttaacgctggtgggctttaatcatttaccctatacaatgccagtactcaaccgtttatctcgttagaatgcgttacaggacgtttgacaatgattagcatgaaatcagtacaaaaacaaatagaaacattatcaaaaattaaacgtaaacagtactcgttagaatatacaatcaatggtaactatcatctaatgaaagagaataatttcattgtcattgatgaatcattgcaagttattagtatagtactgaaagcattaatcaatgacagaaaaaaaattaaaataatctattgacaatatcctccagtactggcataatacttacatcaagacgagaacgtcactaacccatagggtgcacaaatgtaactatataatatcgatcaataaatgatcaaaaaagtactggatcaattttgcataaggcgtatataattctgatcaattcttgatcaaaggcaataaacgcagttgaatttatatagacaatacgaaggcgttactattcgtggtaatgctgggggatatgtagtatcatgtggtttgaataagataagcactagtagtattattgtagcattacagtactatagtatttttataatgaggttaaaataatggcagtaggatacgcgaaagacggggccgaacaagacgagattcacgcagtgattcaggccgccgttaaccacgctagaaagcaaattaacgcacaaagagaatcactggtacattgcctcgactgcggcgataaaatccctgagaatcgacgccaggccgttatagggtgcatgtattgtattacttgccaggaggatcatgatagtacttttaaaagagatccgcgtaattgttggcatagatctatgagatgaaaagtaattgacagtactgaaagatagtgtataatgttttatatcttaactgaggatagtaatcatgggaatacaacatatcacgcgtactactgacaatggcgagatcactggctatcaagtacagggcaaagtagcacaattgcagtactggtttgttaaacgtggaatcattgcaccggatcttgattatgaccgtgtagcgtttattgattctctttatgttgatcctgatagtcggggcaatggtgaaggtaacgaattaatgaatgcctttattgatgccgccgatgattcagattgtatcatcttagaatgcgatacgggagaagataacgcctttaatcttaaagaatggtacgaaggtttcggattcgaggtattgatagatagtgaatatcctatcatgattttatcatagtacttgcatttagttttcagtactgttatagtacttgcatcaaggggaaacatcttcccctactaagaggaaataaaaaatggaaaacttatcaagtattttagtacaagatgatttcggtaatcctggaagtgctatcattgttcggggcaataaagcaacgtttgttattgctggtggacccgtacagcgtagcattaaaaataatgctgttaccattaataatgtacgctatcgcttagataaagaattaattcataaactgtaaaaaagtactggacaatagattatagtactgtataatagtttacatgaaggggagaaatgattctccccactaagaggaaagaaaaatgcaaggtcaactaatcgttcgtaaatggtctgatactaacgaaaaaccgtgggatgtacaatacatcgcccccaatggtgaatccagatatcaaccaggtgtaacgcatagtactgagcaattcgccgccgctcatcgcgaacgtctgttacaatcaatgcagcaaggttccggtgaaaaattcattcaggatcattggctgaaagattaaaaagtacttgcacagtactgaataaagtgtataatgttttatatcggaaggggaatagttcccctcctaacaaagaggaaagtataatggtccaggtagaattaacagtactgaaagatctattttatcggttaggtactaatggcgagtatcctaaaagtgataccgcaaaactttttgtatcactcgacttatggcaacgcgaacaattagtaatgtcgtggcgtaaaggtaaagcagatcgcgaggtgaaagcatgaaagaattcttatttgaagtagtgtttcaaggtgtcggtagtaatcaactgattcgctcaagtggttacaatgttaaccaggcatggaataacattaaacaaatgtacccgaacgctatcacatatcgcaacccgaaagaagtttaaaaataattgaaaaagggattgactccggtcagtccctttgctattatatacgcatagaaacaaattagcccaccgggtgcataaatgtatctattgtttgctggtggctagtactaaaaactatttttaaaaaagtacttgcattgtacttagaatcaagtataatgttttacatcaggacggggaacgaaataagtaacttcccgttaagtagcccaggagtaaggcacacgaaaaactcccctgataaaatagtttgacaatagaaagtaaaagagtataatacttacatcaaccactgataaggaaacataaaatgcggattctactgacagctaacgaaatcgaacaagtactgactactaacctggaagactggaaacgtgaagcagatatccaggcggttcaacggcttaacgatgagttaacgccggatgacttaagcaagattgtagatcctcaattctacgaagatatccacgacaccgcgttaagcgtcgaggatgtactagataagcactttattgatactgatttgcaggtttacggtcgtaaaaactttatcactattcacgacatttacaatacttaagtattgacaaagtatcttagtactgtataatagtttacatcgagtgaggggaaacggttcccctcctaacaaagagagagaaataaaaatggctaaatgcactatctgtaataaagaaatagtattagttccaagtgcccgtgaacgtgccgctcggttcggtggcaaagcgtcagactatacaaaaatgtttactgcccatgcagcttgccaggtagcaaaacgttcacaagaaagcgtagaattaatgcgtaaactttccaaaaaataagtattgacaaagtatcttagtactgtataatagtttacatcaagtgaggggaatggttcccctcctaactaaaagagagaaataaaaatggctatgatccttgcccagaaagtggaactgaaaattataacctcctttgacattaatgttaatcggtggactgattcacacggcaatacttaccactcttgctacgtgtctgcgttaattggcgaccgctgggaagacctgggacatgaaacctttacatacggttacggtacacaaggcgaatacacgggcttggagatcattaaagaaaccgttataggtttcaacccgaaagaaaaagttattcaccgcatcgaggaagagatcaacaaagaaataacagttcgctaccacgatgtaaaacgtaagaaagacatgtaatagaatccatttaaagtactatttgacattgcccagatagtactttataatagactctaacttgtagtactatctcaactaataggatgtataccatgattactaaattctacgctacccgtgaagctgcccgtattgttgcacgcgaggaaggagcagcatttaaagacatgggcaaagatgcaccgaaaggtcaacgctgggccgtacagttcaaagaaatctctgatattgtgaattcacctgagccagtactgacagcagcagaactaaaacgagcggatatgctggcggcaatacttgacgcacaagatgaatttatcgctgattctgatatcaaagtacaggtaaaccacaccgcatggactcacgcggatcacctggcaaaccttaagcgtccaagtgaactgattcgcaaccagaaagagatccgacacgaccgtaagggtaatcgtgtaacagtattcagtaaacgccgccaggttatctaataacttgcagtactaacaacacggcgggatcagttcccgccttttttataggacaaacaaaatgattaaggttcaactatataaagataatatcttacgggtacactataaagcaccacagagaatcatcacaaaggccgtacagcttgctaatgagtttattaatggtaacctattaccaaggaagttaagcaacgggaaactgcgtgtaatcgatgtagacactaacaacagaatagtaatagagaacacaggaaagataaacctatatgaacaccaacaatataataagaaaataaaactaatatcacgttgacagtactcaaatgttttagtactatgtacatataccaacacgggagaaacaaaatgaaattatctaaaatcgaaaagaaaactattgatgaagcagttaagcacggttatacctttcgtaatgattcacattttaccaattttcaacaagggtatcgtactattaaaaaactaattgacaaaggtttattagttgaagtcaataacggtaacggtatcgagtatcaaccaacacaggacgcattttattttaagaaatataatattatctaattgacagtactcaaatgttttagtactatatgtacataccaacacggggagaaacaaaatgattactttagaaaaacgtatcaaagaaactacatcgctggtggaactgttaacagtactcaaatgtaaaacaacaccattcagcacgccggactttattaatatggttgatgttaatggtcgctatcgtatcacggtcgaacaaggagcggcgaaagtattcagtactaaaaacactaaggaagtgatccacgccgttaatgttaaaaaagtagttgccattgatagtaaagtactgtaatatagtttcattaactcaaggagaacatgcaatgcgtaattatactaaattcatccgtacactgtcagaaatggaaaccaacaaagagatcctttcagcttgtcggttagctgacctggagatcatcggtgctggttcttcccgtatagttttcgctttaaatgatcggttagtgattaaggtcgcgaattgtgatgcgggtgtagaacaaaatgaaactgaatgtaaggtatggaattttttagactatgaccgccctcaattgaaacagtactttgcaaaggtgcatatgcatttatgcgatcctgataatatgtttatcgttatggatcggttgagtactgcaagcaaaggcagtgtgaagcacgttaacgcgtgcaatgaattaaagtacaatattaaacgtaatgctattgaacgccagcaccgctttgctgatgcactacaacacgtcgatgatacattatcaacactaacgataagagatatcagaaaacagaatatcggccaggatcgtaatggccttattaaagtacttgattacggtttaacctgcaatatctggaatcagtactataaaaagcgtgatgtggcagcaagtaaagtaacacgataaaaaaagattaaaaaagggattgactccggtcagtccctttgctattatatattcattgagagataactcactgacccatagggtgcggaagtgtatctattatataagtattcagtactgaaaactattttaaaaaagtacttgcattgtacttagaatcaagtataatgttttatatcgagagggggaaatggttctccccaatacaataaggaataaaatcatgactacaatgacttgcatttacgcttccaatcttctgaatgatgcggcctttaatgttgattcagaatatcaatgttatcgggatgaaaataaaaaagtttttgtagttgataataatggtttccatattgaattgcaatccggcttcactggcgttgatggtaaatcagtatggggcgtacaggatgataaaggtacatatcattttaaacgtaattaagtattgacaaagtatcttagtactgtataatagtttacatcaaggggagaatagttctccccgatactaaaaggaataaaatcatgactactactaatcaagctcggtccatcgccaacgataaaaatcatgctgcaatggtcgctggttacattgaagctatgcaattcagtactgtacacaatgagaacggcgaatacctggaagattatgaattatcagagcaagcccatcaagcggcagtgattgcatgttcacgtttccttgctgtacatggtgaagatatggaaacagtacaaaaacaccataatcctgattatacttatagtcatgcgggtcatgatctctttcttactcgcgaaggtcacggcactggtttttgggatcgtgatatcggtcactatgatgatatattcactaagtactgcgaagaaatcaacgtttgcgatccctatgtaggcgatgataatctaatctatatgggcgaataaaagtatttgacaaagtatcttagtactgtataatagtttacatcaaggggagaatagttctccccacaccaataaaaggaaacaaaattatgtccagctactccgctactatgatcattaaagatatgaacggtaatcctacttctgctggtggatcatttggaaacattaatttagatggtcggttatccatgcaatcagccatcgatgcagcgaaagaagtttttaagaatgaatgtactgttagtaagctggattatatgggattcgctatcgagaaaactaatcgttttgtgaactacaaaaatccactgatgattgatactaacctgaaagctaacgaagtggaatacttattatgacagttgaagaagttaaaaaagtactggcagtactacgctatcataatcattgcaaggtgaagaatgatcctgattatcttgattcatccctggaggaagacacattaaacgcaataagccatatgcaaacattagcaaagcgtatgaccgaaaagaataggccggactatatcggaaataaaatttaaaaagtacttgcattgtagttagattaacgtataatgttttatatcgagagggggaaatggtttcccctcaagtccaggagatacaccatgaacactatcgaaatcactatcaatgctcacgtatacgacaacgtaatcatgcaaactactatgaccgctaatgataccagtactttgcggaatatcgttattagttcagtatgtgccgctatcggtgatgttgccctggaaaatgcaaaacacgtaaacgatggtttcactatgtgcaaacgtgataacgcaaaacatatcatcgtggaaggttacggcggtgtagaatttaatgtttatatgaaaaaagtacttgcataataactaaaacaaagtataatgttttgcatagggggagatatcctcccccactaaaaggagtaataaaatggctaactttgatgaactgatgcgggaagtagctaacctggcagaagagaagaaatcattcgattctatctataacaccgctcaccgtgattcagtactggcatgtaaccaggatcaaaaagatgaactaatcgccacctatcatgaagcatggaagtactaccgacaatgggagaaagaagaaagtgagtctaccattgacggcctcaataatctaatctaaaagttttatttcagtactattgacatagcttgatagtactgatatgataactttactaactacaaggggaaacatcatggaacaattcacacaatatcgggtaaattcccaagctatggcctacgtagaagaccataaaacgttaccagtactgcaaccagttaaaggccatatctatcgtgcgatggcgtggagtactacccaggatggctataaaaccgttgccgttggtatgtactgcggtaatggtgaatggtttgatccaaataatccggtagccattgacagtactgaaaaaatgaaatgggccgactacatcgaagatatttcataaaaactatttgacagtactaaccagtaatgtataatgttttacatcgagcgggggaatagttctcccgccaatagtttggagtaaaacattatgtctatcgctatcgccctggttgaagtactgaaagaagctaaagccaaccttatcgatgtacagattaaggaattgcaaaatggcttaatcggctgtacttgtaccgctggtggagcggcagactatcgagaacacgaatcactcgaatcactggttcggtatcttaccatgatcgttgatgattggagaatcatctaacaaaaaagaataaaaaagggattgactccggtcagtccctttgctattatatacgcatagacaaaaactagcccacagggtgcataggtgtatccaaaatatatagttaataacggtgagtaactatctgctggtggagtgaaaactattaataaaaaagtattgacaaagtatatcagtactgcaataatgtatctcgtagggcggcaatggtgcgacggcccacaaagttaggagattcaaaatgactacttcaatcgctatcgttaaagctttcatccgtactaatgtttcctctgtattcatcgacggcctcgaccgtaacgtagaatactcaatcattatcgcacaaacggcaaacggttctcggtacatcctgaatgatagtgaagcaaatcactactacttcactaaagccactggctttaaacgcatcgatgctgatgtagtatacgctaagatgaataagctggtagacaagattaacgcgaaaggtactatcgatttacagtactggaccgaaaccgatccagaatatggatcacaccgctacctgaatccaggtatcaaaatgtaaaaagtacttgcatagtacttagaatcaagtataatgttttacatagagagggggaaatggttctccctcctaaattaaggagttttatcatgaccttctcaatcaattccttcgctgacgttttagtactggctcggacttttggcaaagatgcactggagtacgctgtaagtaatggcactatccaaccggagcagtgccgcatcattggaaactgcaaacgttgggcggtatccaatactattgcactggaaaacttcaacgatggtaacaatgaatattctgttgatgtagtattcgaagccgtagacctgggcggtatctataacactaacctgaatgatgtgcgtatcgttcgcactggcttcggtgcttatgatgtatctattcgtgaagctatgaacaccggatacattagcaaggacttacttgctcacatcatgcagctatggacggaacgtaacgaagcacgtactatcttagggctgtaagcaatacacatcaccaaacatcataggccgctctctagcggccttaactatatcaggagggcatacatatgttctatacagtatacagcgttctaggtacgattgctggcgtacatgataacgtcgatgatgctatgcgtacagtactaacacaagtccccctcaagcctaagactgttaagcagatgacagctagacttaccagggctggcgatggcgtggaagtatggcaggactacggggatacacagataatcgttagcgtaacgaaggattaatgcgtaaagggatctagtactgattcagaaaaaagtcaaggcgtttttaaaattatgcgttaaaaaaatgcataggtaatcccttgacttttttgaaataaaagggattggactatggcaaaatgcgtagggggctaaagggcgggtaaccttagcgacttcgataaaggggtattacgaataaaatgttattgactttttatacaattcatatattatatgattgatattattttcaagggagtccctatgcgtattttaactcaagcagaacaccacgaaagacttatcaataacatggctatgataatgtataagtcacatgaccgtggtattgcctataagcgtgaattaattatggcactattcattggaactaactttcaggaaaggtatgtcaaggattggatttggtatttaattgaagatgtaacgagtaaactatgaaaatgcgtaaattaaccgaaaaagaatatcaagcactgttacgtaaaaacttcacaaagatttataatacagactcacacgtagaacgaatggagttataccttttgattacattgggaactaactatcaggatgcatgggtgattcaatatatggatgcattgaaaaatgaaatattgtccacgaggaaacaatgaaaactataacacgaacccaatcatacggtcttatcttgaaatacatggacttaatggtggatatcagcaaagacctgcctaaaactgcaattgaagttgcaagagcagagatccgcatgttggctgtactgaacacaaaccatcaggaagagtatgttcaagattggattcgatttttaatagaagatattaagagtaaactatgattatattaacacctgaagaatataagaaacgttttaaatctgtccaggctgaaatattacttatatacctttcaaatgcagatcttaacttatcaagggtaatggagaaggatttacttatgggtgcatttttggatacagactttcaggagtattatgtaggagaatactttattgcacttcagaaccacattaagagtaaactatgattattctagaaaaatcatatcaatatactgaacgcatcgctgccagacaacttgaaatcctcataatatacgaagagacttctgatttaaacttagccgaggtattggaaaatgaaatacttttgggtgcattcttgggaacagactatcaggagtattatgaggaaaagtatttgtcatctcttgagaaatacgtcaggagcaaactatgaaacatttaagtaactccgagaagaataaaattatcgttgctgcaataaacaaatattttacacttcctcacacagaaggtttatgtgtaagggaacacaggataaacaccaccgatatacgcatgatggctgtactggggactaactttcaggaagagtatgttgatgcacacattaccgcactgatgaactttataatgggaaaggtaaatgaaacacttaacactagatgaatatgaaactatagtccgtaaactaacccctatagcaaggatagtctacgatgaccccagccttacatggaaccaaatgcgagctaaagttaatgagctatggttgctgtactttatggggactcaatatcaagataagttttgcacagaatatgtcgaacaattaatgaatgttatacaggataaactagatgaatattggctcgcaaaacatgaagactttatcaggagttgagtatcaaactgccctcttctctcttcttaacacccttagaaaaaacaatgcattacatggtgcacctgaagtggatgttatcaacggtgatgtttatcttatgaaattcattggaacaaactatcaagatctgttcattcaacgatacctggcagcattgagaaaccaaattcaatataaaacccagagagccaaaaaagaatggaataaacaatgcgacaaagaatgaaccacaaaatgtattgtaaactattgcagacactggcacagaaacactatgacacggtatctgaaatattaccctatgatatcatgcgtttacttcactgtgaggccgagatgctggtactgatgacaggcactgataaaaaagcaattgccaaatctatagatatgttcatcgaagcacaatgccaacacattagaaccgagatatggagacgagagaatgataaccctaaatgagtatcagtatcattggaggttacaagctataagaaggaaagttgttagtatttctttagacaagtctattgcacaagaggacaaatgtgttataatagctgaaatgaagttgggtgtattcgtaggaacaaactatcaaaacatctacactgacgtattgttaagtgccttacgtaacaaggtgatatctaaagaatgagaaaattacaaggctttgaatacatcagactcctgaaaacatgtgccaacagaaggaaaatcttatcaagcaacaagagcatccctgccaacctaaaacatgcaatgatagctgaactctatgtagaagcactcatagggacaaactatcaacaaatgtatatagacatgtgggttgatgcattagtcaaggagatacaaagtaaatgcaaatgattaatttaagtaaagatgaatattatgttcgtcttgcaaaaacttatccagcacgtaacgccgtttataatagtaacattattgaacgctcaaagaagttgattgtagtaaatgagattaagatgctttcagtcttaggaacaaactatcaagagaatgctgtactgttgttaattgatgccctccagagagagatacaaagtaaatgattaatttatctttccatgaatatcaaaaacgtttaaatgcatcaagggatataaggattcaaatcttcaataacaaaagattgaaacctgacaccagaagaatcaaaataatagaagcagagttatgcaacttcctggggacgaaccatcaggaaggtaagataaaaaactatcttagagaactaatgatttgtatcgaaaataaatgcgaggataatgaacatgaaaatgattaatttaagtaaagatgaatataccgagcgtatgacaaaaattacgcacaaacgtaatacaatctatcacaacccagaaattcaacacagtaagaaaatgattatgatgcgtgagttaaagatgggtgtattcttaggaacaaactatcaagatacagaagtaaatcgcttaatcgcggagttactactggaaatcaaaggtaagctgtacttttatcaaatgacccgtccactaaggtgtactgatcgatgaatattgtgaataacatcagaatagcagaaagatttgatagaattggggaagctctgagacgatacgatacggaatatggtcatttaagctttacgatagaaaagagatatgaacttgaagcagagtttaaaatgcagttccttttaggtacacagtatcaaaaccaatatgtagaaaaatggatttcacttttaatccagacaatttacgtaaggaacattaaatgcaaaaggaaatgatatacttaacaaatgttgagttaacagaaagactagataaatcaagaagacatacaaataaacttcctcacaacacaaaccaaaccccagcagaaaggagtgcagaagttttattccaaacattaccataccttcttggaactgatagacaagattattacattgaacgtataattaaatatctcaaaattactattatggaaaaagtaaatgcaaaagcaaaatgaaatgaaatacttaacatataatgaatacgtcgagagattagttagtgccaagagatatgccaatcaacttcctaatgatccaaaccaaaccccagcggaaaagaatgcggaagctctattccaagcactaccattccttcttggaactgataggcaggagtatcacgttgaacgtataattaaatctcttaaaatcactattaaggaaaaagtaaatgcaaatgcaaatgaaatacttaacagacgatgagttaaaagaacgattaattaaatccagaaaacttacaaatcaacttccaaacgacacaaacaagtcacatgccgaaaggagtgcagaagttttatacattcaactcctgtactttcttggaactgacagacaagagtattacattgaaagtatgcttcgatatcttaaattctctataaaggaaaaggtacatgctcaagaatttaaaaatcctaacagttaatgaatatcataagattgtaatgaaaactaatagtgcaatttctaaaaaatcaaacccaaagtacatactggaacacacatttgaagaacgtcaattagctttagttgaagcaaaacttcttgcactattaggaacaaactatcaggaagaatacatcagaaaactaatataccttttaactaaacacatcaggaaaagaaaaaaagcatgaagcacttgacagatgatgaacatgggcttatagtaatggatgtaatcaacatcgaatacaaaaagttgatacgctaccgttgttatgaagataagcaactcgttctagaagaacagaagttgtttcgactcttaaacacaaacttccaagcacaatacgaagaatcgtatatgtaccttttggcgaggaaagcaaaaagagattatgaaaattttaaaccacagtgaacaaacagaattgttaatctttaatacaagtaaattcttaaacataacattgtctgatatagatgaggatgaaaaagagttacttagagcagatttaagagttcttttatatgttggaactaacttccaagagcaattcgttgaggactacatcgatgaacttaaagaatctgtactgagaacatgcaaatgaaaatcctttcaccaagtgaataccacgaactattaagtagtttaattctaaaattgtatatagcaaagaccacagatttacctgatgaagaaaaaaatattctaatgagtgaaatctatgttaattctaccctagggactaactatcaagaatgtaatattaatgattacatcaaagaactaaaaaggtttatccaatgcaaatgcgaatcattaccgacgaagaatacctaacaatcttaaatggactgtttttgaagttatttgccattaacacatcaaaactaccagatactgataaaattattaagttaaatgaaatctatgttcaagctactttaggaactaactatcaagaagccaatgtgtataattacattaatacactcaaaagggtaatacaactcaaatgtcaacacacaaaccactaggaacagcagaatacattgaactaatggctgcaaacttctcatcctttaagaaactgatgcaagaatcaaataatgatttagaatatcacatcaaaagttcagatttaagattactactcactctaggaacagacagtcagtacaaattcgtacaggagcatattagagcacttttaaatggcatcagggataaactatgaagataatatccaatacagagtacattaatactatatacgattgctggacagatgtagcagtactcaagaagttgtcactaccgatagctattcataatgtaaaagaagaagagatttatctaatggcagtactgaatactaacttccaggataaacacgtacagcaatggattaaaacattacaccgtgaaatacactacagagttcacaggaataaactatgaaggaaatatcaaatcaagagtacttggcactattcagaaaaaatagtcaagaatttctgaatattgatacaaggactgatataagtgaacttcagaaaaatcttttgcgttcagagatgatagtactgacactcttaggaacacagcatcaagagagaactgttaattcacacataggtattcttatacagattgtacaggaaaagatatgagaatcataacacaacaagatattcttaagttcacaagggttcatgcatctgaatttgatgctatattatcaaaaagttacaacaacccttatacagaagatgtacactacaatgaattatgggtgtatatacttttaggtacagatcatcaagagcaagcagtacagaagtatttgacagctttatgtgatgctacagctaatggagtacatgtttaatatgaaagtactgacagaattagaaatgtatcatagatttaacaagtactatcatttacttaaacctatacagaggattaagtgtccctttgtagtgaaacaggtattaatttatgagcataagttatttgtatcattaggtacgaatgaacaagagtattatttgaagttgtacttaattacattaatagatttaattcactataaaaccacacaatctaaacaagctaataaagagaaatatgaaaactaatatacaactcaaggtttataaatcatttgcaagtacatacatcaaatgctatacatgtaactatgtaatggactacaaaggtaagccatttacacttacttacgataatacaagaggtttttatatatcttttgctgattacaaatataacatatacgaacacattgacattgaagatttaagtactttatctgaagaagaatactttcaagaatcattagtatgggatttagagttccctatgtcattagtacataaaatgatagtactaataaaagaaactaagcctgtacctaatggttatgaagatcacattattgagtattaatatataaggtaactatgaaaactaatatacaactcaatgtatacagttcagaagaacatacatatatcaaatgcagtctatgtaaagatgtaatggactacaaaggtaagccattcacaattacttatgattctgatgttaatgatttatatatatcatttcttaattacgaaaataaaatatacaagcacgttgatattaaagatttaagtactttatcaccagaggaatactttcaggaatcgttagtatgggatttggagtttcctatgccattagtacataaaatggtagtccaaatgaaagaagctaaaccggagtttaacggttatgaagaatacacaattgagtattaaatgaaaagattatcatacgaagattacaccaatcttatcaggactttacaaccagaaattaaaagaattaattctcttcctatatctaatgaagaatgttcagtactgaaagatgagttaatcttaaaacacacagtaggaacaaactatcaagcagatagtgttcgatatttaatttgggggttgatgtgtcaaataaagtccagacaagcttgacagtactcttcattactgctatagtacactaacgttaatcattagggtaaaaattatgttaaattttttaaatttccttatcgtcttgtgtattgttcttgggattgcaccgtttgtattagcgtatatggattcagatgaaatgcagaagatgaattgcacaaggacaggacagagtagagaagagacgattcttatgcctgttacggttattgttaacaacatgcccattacaaacatggtccctaccctaacgacaacgtaccagtactcttgtacagacggagagaggtggagataatgcgtaagttcaattgtattgtacgtaagaattcttgttacattgtagtagctgattttaatacgggttctgggttgaagatatttgagtacagaaaatgcaataattcttttcattggaaattaggtgcaagaaaaacaaatacaatttcagtaccgaatttatgttctatctctgaagaagaagagtttcagtacttgttagtacatgatgattctttaggatttacattcgaagatatgaaggaagtacaaaagcagatgattgcacattgtcatcttccaaagaattttgttcaacacgtatgtgaattccacatataagagaagaatatgaaatttaatatagcaaaaacatcgagtatatgtatttttggttatgcagaagagttaggtgatattgacattcttttgtacaaaaaggatggtgttatgcatttcaagtaccaggatgaagaggcagacaattatcttttacctaatttagtacaaatgcaggaagaggaattattccagtacagcttaatatacgacattgatatttgcacgatgccagtattaattagtattcaaaaagtgatgctcgatatgtatgataagctaatacaaggtatgtcagggaggatcattgaaatcgatatataagaatttacctaatgaatatatgttgaagtacaaagagtttattaaagatgtatatgtagatccttttaatatcaaatttgcagagttcgaagtatcattttatctagggacaatagtacaggaccaatacgttgataatctaataaggtgtttgaaaaaggagatacaatgcagacccaaaggtataaaaaggtagattctttattgtacgcttcaaagtacagggatttttgtttacgcggttctggagggggagaggaagatttcgctctgagattatcagaattcaatatgttattttatcttggtacaaaagaacaagaagatacagtacagaaatttatcaatcaccttgtacaaaaaattaatatgcaaattttgatgcttgagttacagaatgagatgaatgaatatgaatccagaaatagttcaggatcttaaaaaagtaatatttcttttgaataccagaagttctttatataaggagttccaagataaggatggttcttttaaaccattatgtatagaattcaatgatttaattacagatgcattgtttgaattttcagagaaatatcaagatacagtgttcggtgttaagaatgctattagtccaagttcaaggaagataacgttatctcattttacatttgacaataaagatttattcagttataatcccagtacatctttatattttattccaaaaggagacaagaatagtcctattcattacggatggattatatcttatgtagtacaaggaaaggagtatcctatcaaatggcacgattagggagtgaagattataatatgaatatattattaagaaatattaatgcagattattgtgtatgggttaagaatcgagatatgatgtattatgatttttatttagattgtgccattaagcgttttttaagagaagaacattaatgaaagacgttaatacaaaagcaataaatgatttaaatgattctttattagtaagtatcaagatgtattacaatatacatttaaagggtggtatagataattacaattattatctttcattagttacaatagagcatttaaattatctagatcatttattacatccaaatcctccatattaaggaataccaatatgaataaaattattttagctctaacatttattttatcaatgttcgctaataccgtacaggccgctgcacatgatgtatatcaatttgattgcagattacaaaacaatgacaaaatcgacatttatttgcacaatacagaagttccgtatttgcagattgagtccacaaagtacattttttttggtgagaattcagtacaggaatttttattcaagcacacatcagaagatgtgattatttctttgcagttcgttgatagttcattaacgctgatgcatttcaaaaatgaaaaaggtttagttaccgttcttaaatgcacaagggtataatatgaatgatattgagttattggtacataagatttgcacaatatcgttagtgctgaacaatacgaatacagtacagagttcccttttaagaattaataaagttgggagtagtttatatttggaagtaaaagctggttttgcaggtcagtacaatgataaaatcaaagaagaagttaagggaagtgaagatgctttcattgaggtttgtgcaacagttggttcaaatccaatttcagtatcacctttaatgcgaaatgaaaattcagaatttgattccagttttgaaggttatttgtggtacaattatggtgatgattattttatatatcagaattccaaaacggattacagtgaagaaggtataaaattcattgatccttacaatgaagcagaagtatttcagacatccctaatatacaatacaaatcaaatgaagtatcttatgttgtttagtacaatgcatttgaatcaattgaaagataatttaaaatttttcattcgtttagaattagttgatattgcttatgatcttttaatgcaaggatatagttatgaagtataaaatgctgtatacaaaagatatgatttatgttgaattagaagacaatgacgatgtatccatcaataggtaataatatatgaatgagatagaattattagcacacaagattagtacagtaatgcttatgctcaagaataatcattctatgcataagtacatttttataggtgatttacgcatagaagatagatatgataaattatcgtttatgtttaaagatgaaagtaatgcaaaagtttgttttgcagcatttgcccaaggcaatccagaacaagcatctcctgttatatacgaaaatagtgaagggtatttgtgggtcaacacaaacgattatttcttttatgttttgaaacaagatgatgaagtagaagcacgaattgatttaattgatattagtacagattgtagtgctgaattatttcagaaatcgttattatacagtcctcgtcaaatacattatctaaagttattcagttcattgtacgcgaatcctttaattaagggttttaaattttatatcaaaattccgcacctttcaaacgtttatgatttattaatgcaaggatatagttatgaagtataaaatgctttatacattaacattaatatatgtagaattagaatccgattcagatgcatggaatttggttaaagaggtcgataccaatcaatggtacatggcaaatttagacgcacaggttgttacggattattttatagattttaatacattatctgaagaagaatttttccaaatgcaattggtggttgacatgtacggacatgacatggtaacattaagaaatatacagaaagtcgttaatgaattccaaagcaagaaagattatgaggtaggagcgtattatgacatcgacgtacagtgagtacaatgaaattcagtacacctacgctaatgccattcttatgggacaaaagttagcttgtattgttgcagccttatataatgcacagaaagcagcacataataaaaaaccatatacaagaatcattaacgcattcatggggtttaaaccatctgattttaattcacatattgcgtgcacgagtcattttgataaacgattcaatacacctgatacaccaaatgcccgtagtgttattggtcttttggatttcgtcccaggtgctgttattggaaagaatgatttagaatacgcatggtataataaaaattccccattagtaatggtaacatatgatacagaaacgaacaaagcaatagagtacaatacatataaatcagaggaagaatttttccaaggttcaatgcttgtaccagtgcgtttgttgttttataatgtcataatgagtacagtacacaatagtccattacacaagaatcacaaaattaatttcaatttttgtgcttatgcgattgatggtgtttatgagtgcttaatggaggtattgagttatgaagctgaataatacatttgatattaataagttaagagaatggtttaataatattgaaattgacgccattccttatcatacatatgaacaaagtgatttacaaagtattgatatcagtgagttgtacaaatattatcagagtgcattagagatgcataagttatttttgagtacaaatttcattataaattacaattttgaggaatttaataattataatttagtacagaaatatgtagtagcaaagtacatgtacaatcaaggtatcaaaggttgcctcgaattcaataccgttcttattttagttgaggtaattttatgcaccgcatgtctgatttagaattcagtttagatgcagcctttaaatttgttcacaaaatagaaacaatatatcgtacattatgtgcaataacatcagtatcaaaagagtttgatgttggtgaaaggtatcaggtgtggaataattcattttataataaagaacattctgcgacggcattttatattttagcatttaatcccagcaattgttacccagagaagcatgaacgttatccaaatgacgacatgtggtttgagtacaaagaagatgctgatatgtcgtcaattgaagttcctgatgattttaatgcacaagatttaacagaagagtggtggttccagcagaatttagtacatgatgatattgatttatttttctatattgcatttaaaatgctttatcacaacaatatagttaaagaaagtttatcgttttcatgtctatatattgatgatttgtacaatgaaattcaaataaacatgcctgtatcgtaagatatgggctttttttgtttgacacaagtacaaatgcatggtacaatgtgtaatcatttttaaggagatacctatggaaaattttaaaataccagatgatttcaattcagtacaagagatggtacacaaggttcattatatttttaatgaattaattattgccaattcatccggtatgcaaattgagttaaaggatattgatagagaagaagtatttctggcttccccaaattcaatcattcctttttatggacaagatcgtttatggttcatgagagataccccaattgacaaatacaaaatacaaaacaaatcagagttttattatatttttgattgtcttaatattacattacaaacacaagatataaatgcaatgagtgccatgagtgcagaggattattttcagtacagtacagtgtatagtccagaagaaatctttgttgttatgctcgttgcaaaattgagtacagttgattttgggacgtacccaaataaatcattcaagattattattcctgcattcgtcgatctttatgatttcattgtgcacaagaaagaaagtacagtgtacgatatgtatcgttcaaatatcagtttatttgcatcaagtgcatccagtgtagtgattacaggggaattaaaatgaacatagaccaattaatgaagtacagtacaaatacaattccagtgctaagtaaagcattagatgcattcaatgctaagtaccctgaaggttccgagttaaatattccttttaccacagaagggattgttgatacgtacattgtaaacatcagtagtacaggtattgttttgaagcaaaagtacggcgaaagtgaatattatggattgaagctggataatatttcaggagagaagacaccttatgagttttgggttccgaataacattgagtcatggaaaacaaatattaataagagagacgaaagaaatttacctcttgtacaaaataatgaaaaaagaattgacgtattttattattacagtacagaccagtttccagaagagatttatttaaattcagaggtgcatgaagatattgaatcatttttctttcagttatcattggtacaggatatcatgcctgtgcaaatgttcagggatgaaataaatttagcgaaagagatttcggatatgttacctgaatttagtgttctttatggtagtagagctttacctgaaaatgtatacaaagaatttatttccattgttaaagggttgaatatataatatgaccgcctatgatatcaaacaaaggcatacgaagtttgatttgttcacataccaattccacaatgatatagtgaattttaacatcaatgcgtcattgcatcctacatcacaagatgattttgacaacagagtgcttaacatcgtggtgcttttgtgttataatcatttcagtgaatattttaacacaagataaggttgaggcacacatgtatcaggccaagtacaatacatcatatgcatttgcacacaacattttgaagatcatcaaagcgttagagggtggattgcttagtcataagtacaccagagtaggtgacaattggttcagaaatgatgatgagttcagaagtcataagattgtttacagcaataattacagtgccaattaccttcaggatgttgctatgtgcttcgaatacgtgttacagttcaggggttccatcagtcctgagctaagagaacacatgtacattcgatacctaccaatgcttaaggatgagaaatcaatattcaattcagtacatcaaagagtacgagagagaacattcagggatattttagaagatgaagctgcctattttcagcaatcattgattgatgctcctgatgtgttacagatgcagaatttgtataatgtattagatgcgaacatcgatacggatatctttttttccttaagtgattatgaaacatttttggaagatttaaaggaaataggattatgagtagattttcagtttatatagtaaacgtcagtaaagatggtagtttaattgaatttgatgtagttgataacaatgataattcatatggtattaaggtacaggacaatgatgtgcagttcagtacaaggacaaattttgaaaatccagtccaagttccgaatttcatagaagatgaagctgcacgattccaatacgaaacggcctttgataatttagcgatgcatattattatgcaacaaagtttagttcaattgcttcaggtattcagacaaaatatatatgtacatgaagtgtcgattaatggcattcaaagttccgttttgttcagtacaaatatgtaaggaaagtacaatgagttcaatgagtttattagatacattagaaaaagacagaagtgccattaagagattaaaaaatcttgtccagagcattgcgaacaacgctgagaagttcagtgacaatcttagtataggtgatataaccagtacaggaataaaatccctgaagtcagatttattaattcataaggaagataaattattatttgtattgagttcagatttaatggttgcaagtaatggtttcaattcgatatcaacacaagatggtagcacaggattatatctatcacagggtgtccagacgaacgaacaaaagtgttttagttcaggagtacagaatccctttaagttcagtacagaacaagctacagagcttttagatgcatcagaagagatgttatttcagtacaaaacggttcatacagattttgaattacgatgcatgtacgctgttaagcattatgttcaggagttcgaggatttaagttatcttttagttcgaacgaatacaaagaacattggtgcattagaagattacatttcaaaagttgttaaagggtgctaaagggtgctgatgaaagagttatttgaagaacagttcgatacatatgtggataatattctttattctagtcgtgctagtcaacgaggaaatcgtgcttacaacatagattacctattaacggtgctgagttcacagtacacctacgctgtgcagaggacatattatggataattttagagatgttgcaaaggagaagttcaagtgcagtttagattacggtttaaatgattttcttacatgcacaatgtacaggaatgatgattatgagcaatccgtaatttcgttgcacagatatttcgaaataatttacgcaagatatcttagaaggttagatggaataggggattggaattatgattacgtttgaagagccggaagtggtatattgctttagtgtgaaaggttttgaatacatgatggattcgattttgaaggatacatatttggttcagatttcagttgcagatgatgcagtacaacgagtattgaatatatacgagaggacgagtcgaaggctttgtgcgatgaaaaggattgaagaaatcaagctttctaggctgaataaatagagacgtttcgttttcacaggccgctggggggtcaaaaaaattttcgctgaaaaacatgttaaggtatatgtttaatataaagttttaaaatgtgttttcagagtacagggcatgtttcctgaaacaaaaaataccccgccgccgaacgtgctccttatattggagtttaccttattaattacagttgagattacaattgaaatgaagatgcaaataaaatataatgaattttgtgcaaggacatggatgtacactggtgagttggttacacactgtaacttatacaagggtgatttaaactacgcaagggacaagattttaaagtactggaatgctgacttttatttgatggattttagtactgggtttaggggtaaagcaaccgagatgttggactatacagtacttgatgatgcggcactgtttcaggaggcattagtatttgataagaagtacatctgtacattagaagagatgattgaaatccagcgtagaattaaatgtattcacagagaatgtatagacatctggtgcagtactggtgatgttgatttttgtaatcatttcaatctaggggaagagtgatggaatttgattttgtaatatcagtacattcttttaagaacagttttcagtacttttgtaatttaaacaaaggtgatttgatgcacagtgcaaatgagtatattcatttcactcagggtaaatttacattcattgattacaattcattacagtatccgcatcaggatatgccggattatacagtaatggatgccgctgaactatttcaggagtcattagtatttgataagaagtacttgtgtacatttgaagaagttattgcaatacaaaatgaaatgaaagagtatgactctttgaataaaggcaatgtcagtattaatcaagaatacaaattcaatataggaataccagaatgacatttgattattcgatgtacgtttgtaagtccagaacggggtgggatttgtgctgtaatcttgtcaagggtgattcggaacatgagttgagtttatatattcagtactcggatttgtgttttaattttattgatgtattgtatgatgacttcgactataactctgaaagtattacagattatacagtactggatgatgttgaactatttcaagcttctttggtgtttgacaagaataagtactcatgtacaatagaagatatgatttttatacaaaatgaaatgaagagatatgttaaagaaaacacctttgatacatctacaccaacaacaagtaattattatttcaatacaggtgagtaatatggaatatgatttttctatgtttatacctaagattagtacttcactggaagtgtattgcaatcttaacaaaggtgattatgaacacaaaatggatcagtacattaaatttaatggttcttactttagcttcattgattatcaggccaaaggaacagttgtagaaaatatgaaagactatacaactgtacagggtgaggctgaaatatttcaagagtcattaatatttgacaagaagtacttgtgtacactagaggaagtcattgaactccaacagaagatgaaagaatatagaagaatctgtatagagactgattccaaagataggtattgttttaagctatgaataaaaaagaacaaatggaatcattcatgaatacaatacttcgacgattcgtaattgatattagacataacaacagcattaggaatgacatgtacttcggtacatatgatattagtgaattgtatatagctaatattcacatggtttaccgagattatatcaagacacaacacaggagttgatatgagttttacaagagcattagaaattgctaagttaattgatttatgtaaaaaggaaatagtactcaatcgactcaatgggtatctattcaaggaaggtaaagcttattgtcgaatgatatacgatgacagtagtgagtacattcacatgtacgaagaaaacttagattcttctgaaacaacactcactgggtgtgatgttaatctggaagataattacatgtacttctgtcgtgatgctgatattttaatacaatatactgacattataactggtgcagcagaaaaacatcttccgtattcagtactggataatgactggggaagtgaagagttctacttccagcagaatactatctacgaggaatatgtgcttgacaagcttgtcattctgtggtactttaataataccgattgtcctagcttctatctggacttggatctactacgagttattaaagaggatatatgagtttagcaagtgcacttaaactggcacacaaaatacatcacttccacgataacataaaaagtggtttctatggtgataaagtaagtgcatttggtaatgagtattatctatcaggtataaagacatactctgatgatattttacttatgggccatgataaagacaatactatacagtactcttcatgtagtcaatatactagtttttttgtatatattccaggtactaagattactttcgacacatcaaatacacctattgacttcggggtacttgatgggccgtggggtactgaagagtattacttccaacagagtcttatttttaaccaagaaatgcttgattccttggttgttttgtggtactttaaggaattgaattttgaacccttcttccttgactggggagcatgtgaatatttaagtacaggggattagtaatgtcattagaaagtgcattgaaagaagcaaagaagattcatgagtacatgattatggtacaagaaggttcagttcctggggtgtataaaacatctgatactgaattttttgtaaaagaccgcgacgattatgatgagtcagagatacatgcagaaacgttagtactacacactgatacgggtgatactgatgactgtgaatatcatatgtacaatcagtacattagttattgtagagatgaagatattataatttacagccctgataacgatgattatgacacaatcattccgtattcagtactggaaggtccgtgggatagtgaagaatattacttccagaacagtactgtgtacaatgaagaagaattagatgttattgtaattatgtggtactttaaaagtattggttctggtagtttctatttcgattatgaatacgtagagaatactgtaggggaagataatgtcattacgaagtgctcttgataaagcaaaagaactacaggtatatattgaagatatcaaggctgggaagttcgaagaagtatacaaagccgagaatggtaactactacaaggatagtgattttgctacaactacagttattcttgggttgaattccaaaagtcccgcagatttttcacaatacaatccagatgcagaatttatcagttatgcttatggtggtgaaatccgtttttataatcgcagtagaccgttaaaattgaactttgaagtactgaaaggtccgtgggatagtgaagagtattactttcagaatagtactttgtatgatgatgaagtactagatactttagttattatgtggtactttaaaagtattgatagtacaagattttatttggattatgaatatgtacgtgaagtatataagggtaaacgatgaaattcttatacagtattcagtacattccaggtacaattagtttaatgtatttcttcgaccatgataatttccagcaccttgccgttagaagatgtaatgaatctttaatgattgaatatcttcacgattgtgattatattcccgactttcttgaatgcgattacagagatgatcatgaaacatttctttttcaggaatcacttgtatgggataagagaattaatttttatgctttacttgagatacaaaaacaagtgaagtactactgggattacttaattacccaagaatatatagagattgaaatataatgtacgaaagtgatcttaagcacgctgaggaattagttaatatagtaaagttctttcaaaataatgtaaagtacttagactataaaggggcatatattagtactataagtgttggtacagatattctaggattaggtaatgaatataagtacgagtcacatgattatgatttggaattcaagtacttcgtatgggattctggaactttctattatatagaggaaggtggaaaatattttgaattcacagaagaagaagtactatttttaaattcagaagatgcttacttccagtacagtactatatacccaaatggggcgttaagagctttagtagtttttaatgcattcctgaaagagaactttaataattctatattcattgatttagattatgtatatgaactaaatcaggtaatatatatggagtccagagaaaaatgagttatgaaagtgcactaaaaaaggctaatgatattctacgcgttgttcagttcttaaaggactatcctgattatgtagatgatgaacgaagagaagtttctaatggcacgaagattacaattgattctttatttgacactagcaacgacaactgtagtactattgaattagcatacgattatatttcattgaacagaaaatatgatgaagttacgatagagcgtcatgagaatgaagaatcttttaaaatttctgatattttatctctgagtacagaagaagggtacttccagggaagtactgtttataatgaaggaacgcttgacaatctatgtacatttagtgtactatatcagaagtcagtactggatatattttatctagacactgaaaaacttgataggttagttgatttcgttactatagaagaggcatccttttgagaaaaattaacattaatgattatgatgcattacaagatttatcaaaaaagattcgcactatcgtaccagtactgaaaaaatgcagtactggattaattgatcctagtacagttattagtgagaagtacgatttccataaactgttacaagggaatggtgcattccagaagtgtgagatacgtgagaaacacgtcattgatacatcattgctttcaattggttcagccgttcataagaatgttgtataccttgaatccagatctgaaactattcgacagatgacttttaagaaaaagtgtactgaaattgacgtgtacactatgatatggggttatccagagttatatcgtactattaatattcctaagtacaattacaattcatttgaagaacagtgctttcaactttcttgtactgatcctgactatgctattattcagttctatatggaattacagatggcatttaacagtaatttaaatatcaatttattaaaggttgatttcgatgaagtattcaaaaacatttaatcgaattgaatacatgagaactgtgagtgcagtgtgggatatatggttcactactaaaccaaaaatggattaccatgactttaagctattgttcttcgttggctctaacaaacaggatgttgcaatgaagggttatattcagcacttacaggaactaatacagaagagggtttatgaaaataataaaccaagatgatattgctaaactattcaatatatattcttctaaaatgatgcaaaccgactcatatagtactgaattcaaagaattaaaagtactgatgtatttgggtacacagtatcaggaacaagttgttaaagaatatattgattctttacagaaggatatccgttatgtacaatgaacttgacttggcatttgagcgtgtaaaaatcttcattgaaacttatcttatgcatgaaactatactgaaaacaaaaggaatatggttcactgataaatttcttactatggctatgagaggtggaatgaaacatctgtactgcacagataatgcaagaatttcagtactgaattatgatgaaagtgtagcatccagtaccagtttaatttctacatacaatgataatgttattagtattatgtgcaatatgaatgtcccatctatttctgtatataaaaactgtgatagttcattggagtacaagattgagcagtacttatatcctaacacagaagaaaacatctttcaaaatagtcttatgtgggatgatacatctactaagtgcatatatctttataataaattaaaagagtacattgttgatagttcaattagtactgctgtattcagtgttactgtttttaatgataatcgtgaagatatgagttattacagagacattgtaagaatacatgcaaagtataaggaactactatgttattaaatgcaaataaatgttgtagtactgaggttcatttgtattttaagaaattagtaaatgatattatctatatgcaagaaatcatttatcacaaaagaatggacttagaaaaagcattagttcagttctcttttaatctcgatggtgatatatcgttaaatggtgatggattgcgtattgcatttgacagaaactcaaatagggttttctattgtgtgaataataaattatgttcatcaatatgtcgtactttttataaccctatttcggacttatatcaattggtgtattctaaaggtgcagttgaagcatcatacggtgatagctttgcactagggaggcccattccatatatgaatacatttgatattgaattagtcagtactgatgaagatgcaatgttcacaaatgatataacaatgcagcgtgaatctgcaatgagatatattacaaattctatgcatacattcttcgaaagagcagaatttgataatgtgtacatagcaaatgtaaatatttttactgacctttgtcagttcttgagaagtatttttgatttcgatgaaagctattgtaagctttatactgaggtttaaatgccatgaataccattagtattacgtactacacaacgaaaaaatacgtttgttgtttactttcattaaagacaaatgatgatatgtttgaaatggcggcatatacattaggattatccgaggatggttttcaatgtcatgaagcgtactcaaatacacgtgaagatacaattgatactactttaatgcaagaagatgagttgtttcaagaaagtttagtatgggataaaaaatactattgtgattttgattttctttgtttaatccagaaagaaatgaaaaggatcttcgacaattatccagtgaagagattgagtactaagccggagcagtacaggagaattttattccgttatgaagactgaattagtaaaaataatgtacgcaactcacaccaagttattattagttaaaatggattacaacagaaaacataatgaattctgtacattaatccgaaatgaggaatcatttacattgcgtgcaaatgataagccaatgctaactataaatgatttttcaggtttagatacaggtgaattgtttcaggagtcattagtactggatagtagtatacatttggaaattgaagtactacaacagtaccagatacttttgaatcgtattatggaaaattatccatgtgaagttggtggaccaatgcaattcaaatcaaagatgtatgaactatgaggttagtatgttagataaaataaagaacaagggtacacaatacaatcatcttaatttggatacgttcgaggcagctatcagtactgcacaagatataattgatattatcaagtacattaaagaaaataagttaaaatgtgtgaaaacgccagaacgtacaatgtacaaagatgacgaccttcacgtatcagttgttaagccaaaagataaggatggtaatcgagatttctataataacagtgggcagtatgaatgtgaatatgatcccgaatttagaggtggattcatgtgcttcagtaaaactgatacttcacatgttgagatacgtacattaaaaggtataggtagatttgagttcatggatatagaactaaatgaagaaaactacttccaacaatcattgcttactactgaatacaatttaggtgtactattcatgtacaagtacttatatgagcacttaaatgaagacttctatctggacttagaagattaccatttagtatggaaagaaatggtagaacttcgtgagaactcttgacaccctccaaatctttgtgatataatctctttatattaattgtaaagggttatatcacaatgtcatccgacctcaatttcgataatgcacaaaaaatcgcacaaaatatcattaaacttcataagttctttttaacagttaaagagaatataattctcccaagatgcacactttatgcgtacaaaaattatttgtcaatgaatagcaatttgttgcatactacagatgagaatttctgtggtattcgtgtacttgacgatgcaccaacaggggattttatctcatattgtttccatacatctgatagttttaagtactatcatcctagatttaatgatgatgaatatgaatatgacacatttaatgttagatcagaagaagaattcttccagtacagtactttgtacaatgagagaatcgtgtttagttctacaatttttacagtacttaaagatgaactcaatgacgcagatgatagattctatatggatttaaacttcgtagatgaaatcattgagtacatggagaaaaatggtctatgattacaacagaatatgattacgatggtgttttagaatttgcatctaacattcatcgcattgcaaaggagttcagaagtccccaacctttcggtggaatgccttttggtggaatgttccaatatgaccaattcagttcaaccaaaggaagacttgcctttaaaaataataagggcaatcaagtatatgctgagttctttgacgataatgactttcactacagagctgaatatatttcatattgccaagggtctgatttgaagattaacattgatacatttagagattcagtgtttatcccttatagtgagttagttttcatgacagaagaaatgtacttccaagggtcttgtattcatgatgcaaaagtacttaatgctatattactttatggtgcactacttcatcattacaaatacaaacaacgattctttatagatttagttgtataccatcaatgcgtggattatttgaatgcataatacaacaacaattcagtacatgacggatggcaatgaatactttgcttcaagatatgaattcaacaagaaccatttcgtaacctatatccctgaatataatcagttttatctacagatttaccaaaatgattcatatatgaatgagatatattctgaaataaaaatccctgattatagtactttatcagaagaggaattgtttcaggagagtactgtcagtactgaagatgtgtacgaactaatggaataccagaaggtacttaaatatttccatgaagttcaggatatacaaatggatagtgttaaagcgtggaattataacacatacgaggtaaattatgttcgaaatgattaaaattatgcaacgatgcattgttgaccaacatggaatatatggatatagtttaagtgcagctattgacaaaaacaaaacaacctatgtaagctataatgcagtacttggatttgatatattcattgatgctaacaataaaatcaaacaagctaaggatgtgtctataatgacccctgacgagctatttcagtacagcttagttctgccaacctgtattgatttacaacgcctaggagctatacagaaggttttacgcgaacataaagtacaaccaaataaaattacccacatcccagaaacattctacaaacccatagaagtagaaacacctgattatatgttaagtgatgatgagttctacaagaaacacttccctggtaaagtttggagagaataatgaacagaaagtacagagaaactatgaagttcgctaaggagtgtttagagacatttgatttcattttcgataacaaagactcactgggtcatcacttcgtaattacaaagaaagaagataagagatacaagtgtcaaagattaggatacagtattgagttctccttaatgattgacggaatgataaactccttatatgaatgtggtaagactgattacatttcatttagatcatggagtgaaggtatcatgttcttgagaacaaatggagttatatatccttttattgatgatttatcagaagaaagttactttcaaaatactttaatttacacagaaaaagaactcaagatgctattcattatgtcgtactttaaaaagtactgcaaatttaaatcattagcttttgagatttctgcaatgaaagttttcattaaaaatgtaaaagaattaaagaggatttacgatgtacatagaaaatgataatgtaaaatgcattactgacatttgtataaaattaatgaaaattttcattaacccaaaatacaagactcgttctttacgtcataacattgatgatcattgtgtcattactattctaggtagtatgcttgatgtaaagtacgatggtaaattgttattcggtgtccgagaagagaagatagatgatgtcttcttttcgcctaaagataagtttgaaccttctgattataaagtaattattcgtgatgatagcatctacattagtagtgatcattcaaattacttaaatcaaatatacactgaaaatgttgactaccaccatgaactactagatttaccaaaatcagacatagatatggagagaatcaaattttcattatcaaataatgagtacttaggtatacaaacatattatgcacttcaaggaaagattccacctgctatgtatataaggattgagattggtaatgtattcagtgagaaggttatatcaattgctgataaaatattgaaggtacaattatgaattttactaattataatttccatagacttgaattacgtcattgtattgcatttgcaaaaacattaatgtgcatcattgatacattatcatctaaaacttttcgaaaggataatgatttgtgccttaaaaaaggtaaagtacaaaaatacgattattcaggagaaacgtattttgatatctttttgggtacaaacgatagtactagagttggatgcataggaacagtaggaacacattgcttcacatggaatccaaattcaagtacagtacgagttgactttaatgatacaagtcatattgtacttagtactgaatctgatttagaatcagttatgttccaacacatgttaattcataaaccaaatgaaattctttatcttgttgcttttagttatctcttacaaaattataaatcaggttttactattgaaactgatatcgatgagattatggatgagattcctagtttaaaagatattcttgaagaaaaagatttctatcaggactttagagatttatacaacatgcacagggagttatctgataatgaataaagatgatattctaatcagactaatcaacagtctgttaaaattcgtgaatagtgatagtgatacacacaatgtaggtgacattgaattcaaatcatttggaatgtacggtgaggacaaaacatattatgcatcaatgaaattccaagattattatgaaatgttaattgcgttaacatacgaagatgtggacccaagatggagttccagtatttctctgtcgagaatggtaattcgtagtaaacatcgttacatttcgtcaaagaatactcctaatttgtttgatattgttttgaatgaaaataccaaccccccatctaaacatgatatcgtacctttaactgatgaagtacagtttcaattgagtaccatttgtgatgaagatgtgatatcatgtatgaaaatttacgagaagattggtagtgatatccctaagaactattacataacaatagatggaacgtacctccgagatgaggctctagcgtacattgacagcgttttaccaaaataaagacccttatgggtctttttgtgtttagtgctttacatgagcattcaggtgtgttataatcgcttttaacagagtacaggagaagatatgagtactgaattaattaaagaaatcacattgttggtaaagcattgttttaagttcattgatgataatggttcacgccagtacattaaagttaatgagaaatataacattaacgtcctaaagaatgaaaccgttaacagttatgcaaacattgagttagatgttgaggacaaatacacagcattacacatcatttcgtccggcgatagaaaacaagattatcgttctacattttatgatgatagtgttactgttggttataaatttcataaaaataaaattgcttataagaatacatacacacatgaagtaattgaagagtacaattataaaattaaaaaagacgagtacgatgtacttttattcaatgcgaacctcatacacaacactggcactgttcgcaatcttatgttagcatatgaaattccaaagattatagaaagaaatgaattgataatctttaaaactatattaaaattcagtacagaagaattagaagatctagtactggctcttaagacgttcatcaatgaacatgtacctgttaaattagaggacttataatgcaagctgaacacattcaaattatgaaattgatgcatgacattgcagaactatctgaaaagcacaacattactgaacatgagcctattggaaattatcgtcttaaagttgaatgcaaatcaccatatcgttttggttcagtagtactggagtcttataaagtttacgattatggaacgacgaaaaaaggttcatgggatactatggcaatgtatatccgtacatcaaggcatagtgagcaaatcggttccattactccaaacatgatatttgtcaatgctttacacgaagatattaatcgaattgttgaatctaattttgatgacgtagagaatgatacatatttggaaattccaccagaactagatcaaagtgaagacattcgtgaagcatacattttccagagatcagtacttgacaacttcaaggagtttgagtacatgatgctttgctatgaaactgcaaaagctattgacactggtgaattggtaatgtatagtaagttcattaactgtgaatccgatacattaaaagagctacacacggcaatcaaaaacatcaaggatacatatgaacgcttatagttatatgacagcccgacaccaacagctatatgatatcagtacaaagatgctacacattgttggtagtgccaaagaaattaacaaacattacctcatccgtgatgtgtcattttcatctaaatgtttgtccaaagaatattacgatcacggtattcttactatttctggtgccaggaatatttgtattgtaaaaaataatagtaaaagtaatgaagagtgcgaaattagatccgatatccaaattaatgatgatggaaatttttcacaccatccattccatattagtactgttggtgttttatataatattaaagtactattcggtgatgaagagtataagttaaaagctatcaatccagaatcaagtacagttgatgaagaactgtttcagatgagcactgttatacctgaagaggttcttagtactgttgttttttgtagtttaatttatcacgaatacaaaaagaaccagttcgatttccacattttaggaacgtacattttcaacactttgagtgttgaccgtttaaaatcattaaatgcagcgatggataagatactataatgacaagagaagattgcttgtatatatgggatataattgacactacactttcaaatccagaaaaatataaaaaacaaaaaagacaacgacacaaaatatggatagatttgttcgttgagggcatacacgcagtgactatttgggattcaccgagggcatcagcatctactctattggacaatgaatgcattgattgcattaattccacttttcatctctacggtactacatatttcggtacatttctagatattgaaagtaaagatgatattgattcacttgctttacaatacggagtactgtatgatactaaattaatttacgatttagtactagcttcttatgtgtataaattaatgatgaaatacaatcacatttctgtatcagtttataccaaggatattctttcattaagagacaaaacatgagtttattaaatgcacgagaattagttgagatgtatgagatcttatcttcatataaaaattccccaaaagatgtaattctcaacaaaaagttccatgtcaatgttgatcatatgaaaaatatagatatgatttctttagtggaaagtagtaaatcgggtcttgagcgtgatatcatgcgtttgatttatattaccaaaccatcatatactaatgatagttcaattagtaatgagacgtttttgtacactccttatactgattgtactttagtttcaatgtctaatcagaaacaagatactatccaattcatcaataccagtactgataacattgaagaaaatgaattccaaaacaatacattaagttcatgtagtagtgttataacctttatgtcatatctgtggtcaatcaaatcaaatgcaattgtatatagttcgaactatacacacgatagtatcgttgaatcatataaagttctaaaggaatactatgaaaataactaatgattttattagaagtttagttcaccctatgcttggtgttatgaaaaaattacagaatctacctgaagacaacgattacaagtttaatcgttttgattcagatgtgttttgtattgaaatggaaattaataacaatcgttattttcatttaaaattcaaagaatcgtcgagttcgtactacaactttgacatgaattttaaaataagcaatgatattgaagaaaacgcaatatcaaatcatattagcagaaatggtttcatgcatagaactaatatgttcaataataaaaacagtattatatctaaatggaaccatcaattcactaaaatttgtgatattgattgcagtacatttggtgaagaactatactttcagttaagtacaatacatgaacttccaccatatgattgtgtaaaaacatggtttgatattcataatataattgatgatgcaatcgtacttccatttgggttgtcaatatcatatactgcacctaaaacgtttgtttttactgaagatatgattatgaaaaagatatgggcgatgatgccacttatgcttgattaacggagaactacatgaatcaaagtcatgatctttttaaattatgtgcatccaaagatgtggaaggatgggcagataaaatcaatacaattattaaccgttatcttggcttctgtgcacgttcacgaagtgaaggttcaatgcgtttccaaataaccatgtcaatcgatggtgttgtaatttatgtagatgaagaaaaactatctattaatctatatgattcatgtgtatttgctattcaccagaaaatggggacaggttggggttgtaataatatgaacaccaatgcttttttctgggtaggtcatagcaacacagtacttgatccttcaaagaaatcaaaccttttagatgataatttggtatatgatttagcttactctgaagaacaacatttccagttaagtacaatacatagcttagttcaatatgaagattgtatcaaagcattagaattatgccattcacttgaacttaaagaaaaattgatacaaatttacccattgttcttccatgaagaagtacaatgcacactagatcatattttatatgggtacgacaaatgagaaaaagttatcaagaagctattgacctaattcgagaagttattaaggtggctcctggtgcgatagcattcaagaagtccctatataaaaagtatggctctatgtcaagtatgtgctgtcaaaagaaacgtagtaaattcactacgcagtactggcacgattctattatcctgagtaatgaacatcagcgtattttaacaatcgaatcagtagataatcaatatggtgaaggaatgatttgtgttcctgactatgatgaaattaatttcaattgtggagattatgagacaacattattattacacgagggttaccctgaaggtgatgtaatggcagagtataatccaaaaaccaaaatactgaaacatggtatgcagttcaaaatcaataataaagatgatgtggaagcagcactaatgcaacttagtactagtgaacctatcactattgatgtagaagagttatggggcatcatttcagtacttaatgagtgttataaaattaaatcattacataagtactctatcattttacatactaattgtgcaatgataaaatgcaagaacatacaagagatggtggttccagatgaactttaaagaaatagaaagtaaaattaagtacttcaaagatattaaaaaactttgggaaaagtataaaattgattatcagttccaagatgatgatacggttcaaagcattgatattaatattcgtgtgaagttcaagaatggcaattatggcgaagttaaattgaatgctattggtgtattccttaaggattatgatggttcttcactcgctcaattcgatttcacacctgatcctgatgatatgttattgagtgaagtcaatgcatatgaccttgagatgtttaatggtaaacctttactattccgcttatcagatgaatgggatgagatttactacacatacaaagatggtgtgattcgagacgtaaatgatgaagtagtaaatgatatggaagaacgtctatttcaagaatcatgtgtgtcatcggagtcatatacatatcaatatctacttgacatgttcgatttgtatagtaaaatagattcagaaatgagtacattgggtattcattatcttacaatcaacgactttgcacaacttgaaacagcggttaaagccctggtcaaagtactgaaataggaatgaataatgaaactgtatcatgcgagtactgtaaaaattgataacttttatatcccgtatggtggccttcatatgggaggtaaacacagtgctttagaagctgcattacgcaaactgagaagcccactaaacgtcgttgacgctgatacagtatacttgcataccttagaagttgatgttgataacgtgcttctatggacggatatgggcagtgatgatgaatggcgtggagtgattgagtactgcgaaattaacggctatgatgcagttcagtaccaaaacgattacgaaccagatacagttcctagctatatgatttgggatacgtctaaggttcgcattattgaagttgatgcgatgcatatggatgaagctgaaatgatcatcgaagatttccttgatgaatatgaaggtgtataatgattgaacctatgacagtactagcacgtactaaattattattgaagattggtgagatattcactgatattttgtacagtgggattgatatacatgaattaggcattaagcaaccgtgggaaataaccaagttctctgcgttctatcgtttatcatataaaggggaaacggttctggactggaaccccaaagccaaattcatggaatatgcggcgttatatggaagcaatggtggtataacaaataattttaaagaaattaaagtcctaattgggtcaaaggaatttaatgatctactatatccagaatttaagttaacagaagaattaatatttcagtactctttgattttaaaagatcttaatgatttagagtactacaaagagttagtagatatttttattaatactcgactttcaaaagatattgtgatattctggtatgttgagtatgttacagaggaattgcttgaagaatttcttctaaatatgacagcaatcaaggagaagttatgttagacattttaggaaacatcgatacagcaaattattttattcaagatgcactgttcaatacagtacagaaagggttggatgtacgatgtaatatccatcagggagatgggtattttgttgatatcactgaaacacgcaagaacgtgttcaatttaaacattacaacattagcacgtcagaacattgcacgtattttggtcaataaagatgaagtagttcttcgttataattccaaattcttgttcacatacaagaagaagactgacatgttcagtactaatttgtttgatgaacccttcaatcttgaagacttagaagcaacattctttacacagaatactatgctgaaattcaatgatgttgaattttcatcagaagtaatgtctgaaacactacaaatggttaaggtagtattctatgcttttcaacagtttaacgaagaacgaaacaaggttaacaacaacagatgaactaatcgcggcgatgggagccaatgagaaatacttcaatgggattcatttttttaaaacgtatcttagtgaaagtaaagtactatatgtatacggttcccagtactgcattgtcgcaaagcacccagattcgatttcactaaaatttaacacttattcaaaaaacttcttgacgattaataaaagcaatgttactatgtctggtatagggaatcaggttgttgagattcctttggactcaattgattcaattgagttctttcaatacgagtgcttaggtgttgattttggtactgtcagtactgaatctatgcgaacattaattaatttacttaaaggtaaagttcatgcttttaactaattcgatgaagaattcatttaaaattatcaaagaaatactaaatgggtctaaaacttctagtgggtcttcctttactagtgaccagatccaacacagtacaaaggattgtactgtaatctttgggttacatagtctgcgtttgacaatagtaaataatattgataacacagcaattgtaatcaccccatgtcatattcagaatgaaacaggtgcatacttacaccacatggggactgtattctacatcttcaatactgaagaaaacattgttaaagaatacaacacactcaatgttgatgcaggtgagttattccaattgagtactgtcaatgattgtaacttcagtgacaatgcagaagtacttccattgtttctaagtcttctcaataacatggaaaaactaaccactgcatacaacaaaagtgacgtaccgcaagcagtattgaatatcaccgaagcaatggagaaatacaaagctgtgacctaatatatgtgcacatggagtgcctttgaagatcaaggatagatcatggagattaaaactgttgagaatggaaagatagatgacattttagagttggacgcattcaaagttcatgatataatgttcaatgtaaaggacataattcagtgcttgtttttatgctgtaaaactatgcacgacttctttcacaatccaaatactaatgttttcatactaacaatcagtactagtaattcgtttatcatgggtatgcctatgagtacaaatgacgagtacattgattgtgttattcgtaacaatgataatattaccccacaatctgaagtacgtaagaaaaagaatacatacactatcaaagatgataaaatcatgatgtgttgtagtaaagggtttattttggataattttaaagtgaaagatagttatcatgattttaaagtatcagagacacaaactaatgtagttctttacgcaagtgatattgaaagcctaacagttaaagatcccgatttggagtaagtatggctaaaaatgtaaacaactttgtacaaaagcatatgaatgagtttaataaacctcaaacacatgtggaccgtaaaaaagcaatgaagaatggtaaagtaaaacacaagtcgagatttattctcgactaattttttgtccaaatttatggagattgtatatgttagatagcactgactttcgcaattttaaaaagtattcagtacttgaacatatcaacgaatttctaaattccccaacaccatttggcatcagtacatcagatacatacgatggatatagaatcttcccatgcaatgactttcaaatttctgtcaaaaaaggtacttcaaaagaagttgcaattcgtgatgtagtactgtatagcgattcttctatttcttactgtcatgatgtgaacaattttgaatctctttcaacacctaattgttcatactacaaatccaatgacactatgatgtacaaagaagaacacatcaatggggtttcgttttataaaaccgccagtgataaatcatatacatctagagatgattttggaaaatatacatgcactatgtatacggatgatgaaaaatcaaatcgtattcattcattcgaatccaaattcaaagagagtgaagtttcaaatatcactatacaagaaaaggttaccgaagatggtgttgtgtatcgtagtactgcattcttccgaatgaaagatattgcaactggtcgcccaatgatgtataatattgacatattcatgaaaggtgaaacatcggaagtggtgattagtactggttatcgtgccaactacacatttacaatgcattcacctgatgcatcgttggtacatctattcaacaatttatatactttccaattcgaacttggtttcgaaacaaatgaatatcaaatatttgagatattaaaaagtaatattattaagaaattggaatattacttccagttaggcgggaagatgaacatagttaatactatgttgtgcaacataaaagaaacaatgtaattatggaggatttggtatggatactaaattcaaacttattttcaaaacagaaccgtatatcccttatactggtgaacgttttattccacctggtgctgtggagattgagcatcctgatggaacaaaattgtatctcagcccatgttcgtatgaacgtgcagttgaaatgctaattatgaatagcaaacactgtagtaataagtacattagctacttatacaatgaacatattctagaatttaatgatgagaatatgtttatgctggctattaacgatttcaataactggcacgaaagtttgactatttgataaaatattgtggacataacaattccttgcgatataatgttcacatctttttttgataaatggagatatagatgaatacaagttctgttctaaaagcgattggtggtgtacttctgattgaagtccagggtgaacctaagctatgttgcttagaagacatgaagaatactaaacacttcagtactggacagattttcaatgctattcgtgttcttaacgacaaatcagtacaagactatggaaaggtatggccttcgtatgtaaatcctgaaggtgaaattagtgctgattggaaaacaattgaagcagtacgtgtgagttgtgagagcgattgggatttcatcgttgaagtatgtgaccaactgcaagaagatgtgccagagattgtagaacgtaaagaagttcttgcacaacttgataaattccgtcacggtactctaccgtatgacgtaatctaatctgatttattaaaaactatctaactaacattatataaaaaggaatttaaaatggaagacaacggaatgaaatttgatatgtttgaaggtgtaccagagttcgatttcaataaacttgaaaatggtgaagaatcagaactagtaagtgttacactaaaatcagataccaaaaagaaatattccccatcagttcgttcacgttctcaagaagaatatgaaaccttcattgagagtattcattacgaaacgttccatcatgcagatggtactccgtatgaagttcgtgttacagtactgaagcctgaagtaaatccaatggaaaatctacgtcctgtttactgctgggcaagccactaataaaccaaaggacgggatataatatctcgtccttttttttgtctggagatatatgaaactttatctaattgttgactacagtaagggttattatgactacacagaagattctgaagggtattgctcgtctactaatgtaaatgtacgcagcagtagtacacatgagcatgaatctattacaaatctaaaagattttattgcataccgagcatttgaaaagaatttctgtcgtagtagatattcgaagtttgagtacccgttgattgatgttcctgatgaattgatgttccagttaatgctcactggagtacaagattatgattacatcgcgtacaatcacattactaagaaaatttatatcggtacgtcaacacatgacatttctatgtatgcatcatgccctgatgatcgaatgaaggatagaaattcacgaaattcatacagtagtggttcagttggtttaaatgatgcattaaataaaaatttattctttgagtacgagtttgataatcatcgagggaaaaaagaccgagaagattattgtactgaaattgatagtaccaatggatatgaagaagtgaaagaagcgttaatgccatatatccttgacaagtactacaaagattttcagtactgtagtaattttctaatcagaaattctatcataataggtcgtcaaagtactgcattctctaagtactacaatgattcccctgttgctgaaaatgaaaactgtaatgttctctcaatcccacgtgaagatatggtattcatgttcacatctttcattgaagatgatgagttgtatgtaaaaaacaagcacaggttcatgccaagtaagattgaggttatgagaagcttaagtgcagatatcttaacgaatttcactgaaaaaacagaatacaactgagacataccataagtttatgatataatgtaaggtgacagcagaatatgttgtcacctttttttaatcctgaaaggttccatatggaaatgattgaagcctaatccactcgaaaagtagagggtagatgagtagtcctttcagtacgaacagcaaatgaaacccgttagatgatggcatagtttgaaccactcacggcaatgcggctgtataaagaactccaataggataaagagagttcctcgatagacatataaggatcgcaccttaccaattatctaagggagatttcatgagaaatttgcggtcgtaatttatacaaaatagttgcgtccaaaattcgtgaaatcaaatacaagtactggtcatatggtatttgtattatgtgtcgggatgtttaagaccgacgaccgttgctacaagaaccgcgatagagagaaacagagcaacccgctttcgcctcgtaagagaattcgtgatatgaactatgtgaaggccaccagcgtcaaacttttttgttctttcccctgcggggggatgaaatatgctcaagcaaaccccgtcaatattaattaaaacaaatcatagtactttcgttgaattagacatgcgaagcgtgtataattcgactggtgttgatgaagtcaacgccatgtacagtcattgatgtttccataggaataatgatgtcatttattaaaaaatctaaaagcgtcacttataaaacactagaatttgttgattcagacaatcagaaccaagaccaagagaattttactggttttgttgtgattaaagaaaagggatgtatttcgtacatcaaagagttgcagtgcggttttgaattaacttccattaagttattcccaaccaagaagcctacaattcttaaagctcgttatgggaactactacgaagagcgttatagtaataatctaatcagtgcgaaagcacatatcgtcaatggagaactagaaggagaatatagaaaattcaacccacaaggaaaatgtgtttgggttaaatacttcaattcaggaaatgatgtaacatcagaaattattgagtttttaggtttaacatgtacccttgaaactcttcatgattacaaatttaatactgaagaagagtttaatctgatgatgcgttatggatcacattttaaatttttatatgaatacaacattgacagtagtacttttgatgaaatagtacttaactgtctataatcaaaggaaatagtacatgccgaaaggacaacgcggtggattggtttatggatatggaataaatgacatagttggtaatgaaattgatggttatgcaaattccaaaaataaatgttaccaaacttggggtggaatattggaacgatgtttttcagaatcatttcatgaaaagtatacatcctacattggaactacattatgtgatgaatggaagtattattctgaatttaaaaaatggtatgatgataacaaaaaagatggatatgaacttgataaagacattattggtggaaatagaaaacattactcaccatctacatgtgcatttgttccatcgataatcaattgctgtattttagatggcaaaaaaagaacactgaatcttttaccattaggaattacataccataaagctgaaaaatataaaaataaaccgtatgaaacacaacttcgtagatataaaaagttaattagttatgggtatcattcaactccagaagaagcccacaaagcctggcaaattgccaaacgtgattacttacttgaattaatggataagtatagttcagatgttataccagaggtaattaacggattacaacgaagggttgatatactttcatatgatataatcaatggaaatataacaataagtataaaccaagtataaggagaatacttcatggaagaagggaaaaagaaagacaaattggcaatacactacacatcaggtcacgatgtatggtgtaccccaaaagatttctttaagaaattggatgatgtgtggcattttacattagatagtgcatgtgttaaagaaactgcgttatgttctaagtactatacaccagaaactaatggtttagtacaagattggggtaatgaaattgtatggtgcaattgtccatatagtgatattaaatcatggctaataaaatgcacagatgcatataacaaaggggcaactgtaatgattttagtaccatctagaacagaaactatagcttttcaagattatgcatgtccagtatctgatgcaatttgctttattaaaggaagattgaaattcgtagatccacataatccacatagaaaaacaacggtagctccgttcccgtcatgtctattagttatggatagaaatctaacacaagctaaaataaacttactcaaatctctcggaaacacgatggttaacatatgacgaaagaaacatgtatattatcatttatgagatgtaacccaatacatcacggacatggtttagtgtttgaaaaagctcaagcactacaagaacagtacaatgctgatttgaaaatattccttagtaccagtactgatgccgtcaaaaacccattacctcctgaattgaaaatgtactatacagaaggattttacccatctgtacaagaaaatatctatacagaagataatctgtttgatataatgagagaactggatggaaagtacttagatgttcttttcatatgtggttcagatagacttgaaccattccaaaaaacacttgacacgtacaatgggaagttatataatttttgttcaatcaaggcagttcaagctggaattgaccgaaatgtaagtcgctacagttccacacagatgcgtgagtttgccaagaatgaagattttaatagcttcagtacttttctacctggtaatgatgatgcactgaaaactaaactatttgaagatgtaataaaatacatgaggaaataactatgtcagtactgtttaaaactaacccagtactttgggatcagaatgaggattcgggtttccgttcaatccatgttgaattcaaaggtaatacggtggttgcaatcattgcaaacaaaactttaggaaactggactgcacaagttgttcctatgggatattcttatacatctgatgaagttgcgtttctggctgaattatatagtcaaacaccattcatcatcaatgttctagagcgtagtgataagttaacacatgacgaagtaattgacttcctggcgaacttacatgtctgatgattcgaatctaacaggttattttttgcaagaatcaatgatcaaattcagtgaacattttccagtactagatggtgtggagatgtggcatgtaaaaccactcttccacactttcagcaaagagcacaaaatgttattgactgaggcttgtaaatcgaataaaatatgccaaatcaagattggtgtaaatgtctacaaaggattagtcatcttttttgacaacaacagcaactacttttatattgttaaggagcattacgttgacaaatacaaatactaatacatactttcgttatcttcgcctagggctttccctacgcccaatccgtggtaagtgtgattcacttgctgatttggattatgcatatgcattacattgtgatggtgttcaatatgtattaggtgactatggtacattcgaagaatccaatgacagttcagaaattattgctggtgttgctaaccttaacaacattgccaatagttctcgtcatgaaatcgttcttgaaattcagaacttcattgagaaaaatactggcaagcgtacatggtcatatgtcggtactgatgcacaaatgtcaatcgcatttggtaacgaagatggttatgtagcacaacttattatggatttcgaatcagaagagaagttccaagaatacaaggaaaaaatcatccaatccttgttgcaaatgggtattcctgaagatcgtatgcctgaaattcaaagcattgatgagtttgttcttatcccatctgatgaaaaatatgatgcgatgtttacagcactgaacattcctggtgtagtggttgagtacttcgatgatggtgatgatggcatttacctagatctcgacgacgatgatgatgacgatgaataacacatatagcccgacataagttcgggctatttttgtaaggggaaatatgaattacaaacatatacaattcacttatatggaattatttaaattacaccataatcacagaagtactaacacaattaataaaaatgcgtttactcataaattatggtcaaattacctagaagaattacgtgagtattttgttgatactgaaattttcattaatgggaagaaacgaaagatacttagagtcgatagttttggtggtagattagtactttcatataaatttgataacgacttattctctgttgatttggtgaatatatgaattataaagatttccaattaacattcaagtgcattcgtgacctagcagataaaaataatagtatatttttagaagatacatgtattgaaatgattaacactgtgcgtgagaggattaaagaaaaattcagtactgtaattattaacaacgatcatgcagaattttcagatataatcattaagcttgatggtaaagtcgaggtacagttcttcactgattttggatttacgagtgttcctctggagatattcccttgaaattaaatttgaatgatgttcaattcacatataaaaatatatacggtttgtatgatatgtatctttttagtgggaagattggtgaacatgtcgaatcaaaagaatcaccatttattaataattactatgattacttagattctattgctgaatatataaaaaagaattacagtacttacactgatggcgatgatatattcgaatactcaggtgtaaaatcttatcaaggtattatccatgtagaatttcttgaaaaaactgatagggaatttatggagatcaaagttttgaagttaacggacctataagagttgacatatgaatattaatgatatacaattcacatacaaatttttgtatatccaatacgctacggttgatgctggagaatatctctacggtgaaatctatcgttcggtatggataaagtttttggatgaattacatgaatattaccatgatttgtgtatagttcgtgataataaaatatacaaattccgcgatattgttagtcatagcggtaagctacgattggaattaagtactgatagtgatgttgattggattggtgtaaatttactggagttggagaatgaaaaacaacttaaaggaaatacaagtattttataaattcttatacttgtcatatgtaaaagatgagtactatgaaagtgtgtattattttttatggcaacattaccgtactatagtaagagatttatatataggaaaatctatcatatccaatggtgaaaaatgtatatgtactgatgttgttagttttaatggttctttaacactgtgtttcagatgcgataataatagtgggtcattttcattaaacgtatatcagttagaaggaataaattttgaataaatgtccatattgcaacagtactcaattagctcgtttccgtttagattcagactgggcctctggtgctggggatttctttccaatcaatgatgatgcggaatacactgaagaacagcacaaagatttcgataaatcatggcgacctgacattgagtgcatttattgtctggcatgtgagcgtattcatgactaaagctgaactgatcgtgcaaacactgcgtttattgagggatttagatataccacgcatggatgtgaaacttgaagatatctacattgaatctcttagtgaagattacaccgataccgtaatgatgctgaatgacgtgctttatcgtatagatagcattagtcgttatggaagtactttaaaagttaatatggaacgagttgataaacttcacgtacatatatatagtcttcccatttcaatattaaactacagatgaatatcatattaatacaaaaaacatatgctctactgatgaaagaatatactaatacttatgatgaaaagtgtagtgcaaatcataatatgtataaattcattactcaagagtacagggattatatatatgctgcgttagttggtagatatttcagtactaaaaaacgcaaagaactaaaagtagtagatgttacttttttctacaacgggcatataacaattcatggtgtggaacataattcacaaatatatcgtaactactcatctaacgaggtaacatttttatgagagcattattttttatctggagtcttttctcactggcagtaataactgtaagtgggatttgtttcttatcgacaatgaatgtctggtacattaatttactattcccattcgtaggtgtaggtttaggatttactttacatagtgtttgtaaggattttaatggcaaataaatcgaatgaagtacttgttgctgaaacaatgaagatggtttataccataacaactagtaatgatatgtcttacccaattaagtccaagttgagagatataactcttcaggttatacagcagtactacaaatctaaacacaaaagtattattaatgtttatcgtgactatgaaaggattcgcattttgttctggaacaagaatcgagttcgttcggaatgtgatatagaaaactttaaatttgagaatctttattgttacaaagcgggacgatagctcaagtagtgatataataatggataaggaacaataactaacacaaggagtgtggaaagtgcttgaccgtatccgttttgccacagagatggcgaatgaattaaacatggcaaattttcaaatgttaacatcagtgatggctgaacatgcatgtgcttattctgtaagtggtgtgcagtgcggtcaggagaatatgttagcagatgtatatagcgaagttcaaagtaaacaatacagtgtaaagacgtacaaggataagttcgttagtctttatatgaatgaagacattgcagaagaccgcaaatatactgattttattattgaacgaagagtatcaggtgtatccaacccaaatgctgacagtactacagtatttgaagaagtacttcaagatatatatgaaaatgaattgaaaagtaagaatcattacaatgtacgtgaaactaacacagtgctcttgggatatgatgaagacgatcaatattattatttccgtatgactgaagttccttttgaatataaatcaccaagtactactgctgtaaaagaatttaccgagaaaagcaagaactacaagaaacatgaaggcaaccgttgtagtataaatggttataatgaagatggtgttcatatatatgaatgggttcatcctaattgccagacatatacccgttgcttgaagaaacgttataatttagaagacaatgaatccttctactttaaagttaagaaacaaggctatactcgccctgaagattcagaattgatgggtatggtatatttctaaggaactgttatggatttttacctacacacatggtcatacgaacaatacattacattatatcttgagattattaatactgatcccagatatggttgtgattttgctgatattataaaagagtatgcagatgagtttgagtttgtatatcttggctctgacctattcgtgaagagtgtaggtaaaaccggacgcatcactgagattgattatgatactgttagtgtgaatttctatgttgattttccttgtgatggcgttgatggtgtatattgtctgtatgaaataatttaaatgttaaggccagcgtttgctggtcttttttcgcaggtacaaagatgattagtatagatttaattaatagtactataaagttgttggctgatatagtaagagaatccaatggaactttatacccatcaatgtataaaatctttgaacgatacatcaaggattgtaacatatccttatatggactggcggttgatatagacgaccactatgaaattaatacttcatataaaactggaatgttaattggtattaatataaagatgggatattttccttattactgtataggattaccagatagtactatggtagattatccagccagtattattaaactaagaggataaaactaaaatgaatgtattagaattatgtactaagctgattactatgcgtaatgagtggtacgattggttttataatggtactgatatggatttttcaaaatatccatttatggaatcaggatgtgatgcaagataccgctggttgagcaaagattgttctggtttacatattctagttgacgatagtggtcagggaattataaaagatttacttcaagttcaacaactcgtccatgataatttgtgtgataacgatccataccttggaaatatgatttatgtaagtgaagatgattgcatattcgttatccagcgtcatggtaattctatgttttatatagcagacagcagtactccagaaggtgcagcagcagatggacttatgcctaagattgatatattggaatttggattacctgagcacttccagattggtactttatacgatattcccccacttgagttctttgaagaatttaaattgtactacaatgatcttcaaaaattgagtactgatcgtcgcattgaaataactgttaagtacatggacggaacgaaattaaccgatacgaggatagaattttgattaaagatttagatagaattttatatgtactgaggggtgtaattacattacaaccacaggttaatcgtatggagagagcctttgaattaaaatcaagagaaactccatattcacatatatcaaatgtagttggttcattcagtactgaagactcgccttacgatatttgtgtatgtgaagtacagccaagttcggatcttggatttgctatttttgataaaaatcaaaatctcattagtatgtttcagtgcaataatcctttttggaaaacatgcctgtatccagagtgggctatgcttgatccaacaaagagttccattaaagtatatgactctaaaaatgatgaagtagttattgatttggatgagtcaatgtcagaggaagaacactttcagctaatgatgatgcgtgctatgcctgagtacaatgcaatgattaacactgtgcaatacattaaggataccatgccatcattgcgtacacatgagttttgtcatcctgtattgtatgaacatttagatttagacttcagtactattaaatttaaagataatgttattaattacattcaagagaatgttaaatttgattttattagtacaatgacaaataatccaaatactaatttcaggcatcagtacaacgaatctttgtctggtggtcgagatacaacttggtggaaataatatgaatatccaagatagattgcaattgttgcacacacttgaagaagctgcttttgaacttgttaataaaattgcacaagaactcccaaaaggaaccaatgttcgtgttcgtgaaatggattatttaacgggagaaattgaagaaaaagtactaacagtgatcaaagtaacatactatgaatctgagttatcaattcaatgtaagtcggataatggttacgtttcctactatggcacagatgtagatatagaggtaataaaatgacccttttacaaatatatgaagatttaatgcacttatgtaatacccgtgaggctttcttttatgtggatcataaaagtcctgctggtggaacgtatcgtgtattcagttatcgtctagcatcatatactgatttcatgcaacccaatgcattagaaacccgtggttctatgtgggaaattgatgaagaaggtaatatgattcgttgtgctgctcgtactatgaaaaagttcttcaatgcttacgagaatcctgctacaatgttccctgctgataccacattcgatgacattgcagtagtgatgcctaagttggatggttcagtaatcagtacttaccgtgataatgacggtgtaattcgttgtaaatcacatactgcattgtattcagatcatgcgattaacagtactcgtcttctcaatgagaaccaaaatttgtatcaatacattgacgaagcagaccgtttgggctatactgttaatctggagtatacaagtccagagtaccgtattgtattaccatatcaggttgaacaattatttgtactaaacgttcgccatcgcaagagtggtgaactattatgtggttctgcgttacgtaacaagttcccatgccttgcacagtacagtactaatatgacaggtaaagatattcattacactttccctgttcgtactacattcaaagaaagtgttgaagaagttaagaaaatgcttgacattgaaggttttgtgtgcatcctaaataatggtacaatgtgcaaaatcaaaaccgactggtattgttctttgcatttaacgaaagacagtattataatcgattcccatttatatgaagctgtattaaatggttcgagtgatgatttaaaacagttgttcagtactgacgaatatgctacccaaaagatattaagaatggaacaactagtcttttcgtgctataatgctttacaagatgaagttgaaagcttcgtcaaggaacacaagcacttggagcgaaaggaattcgctaagaaggttcaggagtgtttaactaatgaactgaatcgtcagggcttggcctttgcaatgtacaacaataagaaagtcgattacaaagagactcttattaagtacatgaaaattgtactaaaggatttttagtactatctagcctagcacaaggagaagtgatggctaaacctaagtataaaaatgacggttccctttctccgacagaattcaggaaaatacaagaagaaatcgatgaattacagcacaaacgctctaagaaaggtgtgaagattagtaagaaacgaatcgagaatactttcgggtgtagtagtactgaatacaagaagaaaaggaaaccaaaaggtgttaagccgagaatacatgatgtaactcgctatacatcgaaacgtgaaaataaattcgacccactataaggagttcatatgaaagttgaagttcagcatagtattgttcaggatatgtcagtagttaaatttctttccttgaaagattatttcagatgtatcaagttcctagaagaatctcaattacagtggaccccattaaagtacagttcatccaatgatactgctagtattcgttgtgatgaatctgtacttgtgaaaatctccaagcgatttgggattgggaaatacaatgataaacaatgcacaaagtaatttactgtatataaagtcagtagaagctgaaattaaaaattcagtacaaacaatcgttgatgaaatgattgacaaatacaagaacaatcttattggaaagaaagtcagatgttgggattacacattcaaacactggtatgattctgagattgtgaaagttgatgtgaatactgatagtaatggtctaattaatggtattgcgtatattggtgttttaatacgcaagggaacgccacaggaatggctcacctatcataatatagagcatgttaaatttttagaggattaaagtatgccaactatcacactaacagttggattgcctgggtgtggtaaaactacatgggcagtgcaagagattaaaaaagccaaatccaagactatcaacatcaaccgtgatgatattcgtgaatctatggctggttcacatgatgcttacaaattcaatgatgctaatgagaagtacgtaactaatttacagttcagtgcagcaaattcagcagcagagaatggttggaacatcatcgtatccgatacgaaccttaaaccacatttccgtgatcaatggaaaatgtgggctaaagataatggttatgattacaaagaaaagaacttctatgatgattttgtacctaatgaagaccgtggtgcagatgttcatgaattctttaagattaaagagttcgtaaaactttgtaagaaatataatctccagcgtgagcgttcagtacaagatgatatcattgacacaatggcagatacgtactattatagtaaggcattacacattggttactatggtaattcacgcgaagctgctatcatcgttgatatcgatggaactcttgctcataaatggggccgtaacccgttcgatgaaagtactgtactccaggatacaccagacgaagaagttattttatctgttatcgctgaagcagtttttcataaacgcaaggtaattatcatgagtggtcgcactgaagggtgtcgtgctgataccgaacagtggcttaagaattggggtattccttacgatgcattgtttatgcgagacattgatgataaacgtcctgatgatgttgtcaaattcgacctgtacatgaaaaatgtggttgatcattacgatgttaaaaaggtttatgatgaccgcaatcaagttgtttttatgtggcgtaagctacttgggttgaaagttttccaagtggcagaaggaaatttctaatacaaaagggatcatatattggtccctttttcttttaaggtacattatagtgaatgtaacaacacagatgttattacgaaaagactacttagaaaatatagaacgatactatagattgtctttgtatgaaaataagcataaaaattatagttttgataaactactaaattctagtactgaagattatctattttcatcaatgttttatgtgagaggattattgtaatggataaatttcacacagatatatcacagataggtaatcttatcaatagtctaattactgatttagaagaaaagtacttaggacgaaatgtatacttagaaatgtatgaaacatatggtgttattgatatgatttattacagtgcattgaagtgtgaaatacgtttaactgtatgtttatatgaaaaaggtacatttaaaagaagtactgcaattcgccaagttggagttgatgacatagaattatacgaggaacactgatgtttgagcaggacttagagctattcaaaagttatgtcgagtacttagttacattagaaaaagagctaacgacaaagtacaaaggtattcgtgttatgtgctggtatgatgattcggattataaacgtgaactcaccattgaccgaatctatttcatcgacggtgtattgaatgtgcatggtgtaaatgattttggacattcatatacgtattcgaataatgctaaattcaagaggattgacaatgaatgagtactatcaaaatttattcaattatataaaactaatagatgatcttgcttttgattttcttagtactgataaagttggtgagcctttatattatgattgtattggaacactttgtttagatgaaaaagagatattagcaaacaacttaccatccacggtctgtacaatcaatggttccaaggcattagtgtgcgaggttaattttcataaatcacttaatacaattgtttacaagttcgataacacttgggtaaatcatgtaaccagtaatattaaatctgtgagatttttatgaatataaaaaaattatttgaacaagtaaatttattgtactggtgttcagacgggtcagataaagaaaatagtgaagcttttttagaattattcagaaatgaaatacacataattagaagatacttaattgataataaaactgaagtaaaagttagataccataatggtactttaaagaatggtataattattggattgatagttacacgaatgtctagtaatattaaagttgcagtaagattaatgactgatgatggtgtctacacaatagaagctagtgagattatatattaaatggatatacaaacattcaataaacttaagtactatgatgatggttttgcattaataattaacgaacttgatggaataccttacgaatatcataatcaattaatgaagataataaaatgtatatgtgaagaattaaaaagtatatttaaaaatgaatatgtttatgatttaggtaatagtagcaaaaaactatacataaagaaattctgtggaacgcattgtggtctgatggttgatttaggtttaagtgctgacaacaatttcgaagcatgtagtttatatctggatgaaatgcgaatctcatgagacatatcttgattcggtgatataatttcattacaacactgacatggagtagttgttgtgaataacgatttttttaaaatgtgggaaaaaacaatagtaattctatctagttcattaatgcacattttcagtactgataattcttatagttcacatacatttgatttaatatgtaataactatgtaaatgggatatcagatgatttatgtccattcattgcgtattcacctgatggcattgaagaatttaatatacaaaacattcgttgcggttttggtgattggcttgtgttaaatgatcgaggtggaatctgtttatacatcgaagatattggtaaatttatatacaaaggagtagaatatgttaacaatcgcagcagttattagtgtactaggtgtagtcattgcaggtatgcttgcctacaattacaaccgtagtgttatcggctatgtactacttagtctagtactgaccccagtactaaccatcgttactttattagtgctaggtgaacgtaatatcaacttcatgattaatgataaacgtgaccaggttacaccagaacctgaaaaagttattcctgaagaacaagaagaacttaaagttgaagttcaaatgcaagtgaatgttcacaatgcacttgatgaaactgatccaaaagttaatgttactgttgttcctgtcgtcaatgaagtaaagcctaaagcagcaccgaaaagtactaaagcaccaaagaacaacaaaactacaaagaaagctcgctacacaaaagggaagaataaaaacaaagtccaagatgaaccacaacaaggtacacacgaccatacttcccatattattaccgcagccacagcagcagcagtcgtaacaccatatatctcttctgctgatactggctcatatgatagctctagttgtgattcaagctcaagttctagttccggtagctgtgattaacaatgaaacatctcgcacaatataatcagtacttgattgcgttgcatcaaatgaaagatgatttctataaaagtgcagaaacagaactcgtcggtaagatagtaaaatttactgacgagtacatcaaccgatatgcggaaatagacgatgatccagagtatgaatcatactaccagtacataaattccaatacaagaatgagaattattgaaattatgaaatacggtatacgtttaattgcacaagtagaatacatcaatcacgatgcaattgatgccgctgcctttggtgatgaaataagtttagaatatcttattcaaattgatgaggaataataatgactacattttttgcaatatatggatttgttgcgttttgctcatttatatgtaactttctagtactgaattggaaatgtttcaaagatgaaatcataactgcaatgagtctacaatcagcagcactaatggctataatttggcctgtaactatggtgtatctttttatctcaataacaaaagatatcatatcccacttcaagagaaagaaataatgttcaacaccgactattcacatttgcgatatcttatgtcattggctgatgattttattaatgatttgaagccgaagtatattggacaagaagtacgtttgataaactcaaggggttatgggaagtacattatcgctgatatgtatattagcggtggtgaatggcgtttcaaagttaatacgtatcttaaagatggttcttttgcaggtacacaagttacaaaacacactaacattatatggttggaacaataatgaaacattttttggaagttacagtaccggatgataaagatttatatatcgttggtgatttacacggcaatggaaaactgtgggatgctaccaagaaagaatttggtatcaccaataatgactatgttttttgtgtaggtgatgttattgaccgtggtgaccagaattccaaactactatttgaattccttttcggtgaaaaccgttttatgattgctgggaaccacgagatcatgtgtgttgattctgaaactcaccgtgactggcatcactgttgggtacaaaatggtggagataagttcattgatgaagttggtgagacaggtatacagttctttcgtcagtacttaaaggatctccctatgattatccaaatcaatcaccgaggattgaagattggactggttcatgctggtgttcctttggaatataccacatgggaacgtttcgttagtgggacaaaatcacttagtgctgatataattgagaagtgcttgtgggaccgtgatacattcgactactgcaagaaaaataacacatattacgtccctagacttgatggcatccattgcgtctttagtggtcataccgcagtatccgacccactcatctacggtaatcgtatctggattgatagtcagtttttaactggtgatttgactcttgcaactccccaaagtggcgggatgagatacttacgtaaagaaaaagatgagtattcatttaaccgcttcaaaaggtaataatatgcatgatgatattaaaaaatcattgtatgatttatatattatgaaaaaaaccatcaattctatacttgccgaccagatcaaacaggtacgtaacttcctatcaaaaaaacttattggtgcagaggttaaattccattacaaaaaaaaatgtcgtggttgatggtgttattagaagagtagttacaatttcagaccaaacaatatatgttgaagttgaatatgatggtaaattatcacaattaagtactgaagatttaacatttttataaggaaatagaaatgaaagtaattcaagttatggtagaaaaataccaaaccgaagatggtcgtatttttgattcagcaaaacaagctgaacaccatgaacgtattatttctggtacacgtaaagtgtgccctacatgtaatggtacacaacaagttccatctgaagactatcgcagttattatgcttgtccacattgtgatggtaaagggtttgtagaaaaacaagaggtatggaaatgaaattatattgcttaacaaacatgtactgtcaaggtgtccaagctggcattcaagcatttcatgctggtgttaaactaattaaagaatatgaaggtactgctttcagtactattattgatgaatggtattatgaccacgaaactattgtagtactaaatgctggtggtcatgataagttaaattcttattatgatgacctttgtaagcagggtaaagttccattcgctaaattcaatgaagccggattaaatgatgcaactacatgtgtagcagtactatgtacatctgaaatggttgaagacatgtctgttatgcgtatgaatcttcctgctggggatcaactaatgcaagtaaaatatggtgcattgtttaacacattaaaagcaattagcacaatgaggactgtttgatggattttccagagaagttatttgtggctcgttcatatgtaaatcataaccaagttactggttacattatagatgccacaaaatcacacacaaaagcgtttgagactaaaaaagaaaaggccgagtactgggctaagaaaaacaatctaccttcactatggattgataatgtgcctacaattgggttttctgtggtacataagctcactgttcatgctcgtgaaacatacttcaccatacgtcaccctgaaggtttcgagttcttggtgagtgctaaaaacatgaacgaccttatcatcaacaatgatattgttaagggtgtatttgttgaacctatgttcttcaataatagtttagaactaattaacggtaaaactaaaacctttgctaaattggttgagaaggaaaataagaaagaacaacaaaaagaagttgtttctaaattgaaagtgggtgatggttttagacacaataaagaagattactattattgtggtaaagtaaatgctatttgtatcaagaaaactaaagagttttcattttctgataagagttccaagtatcacttagtatataatactactcgtgggacatatgctcttaatgctcgtcttgaaacttatgcattagaaccaagtgctgcactgaatgtgaaaactacagttcaagatgaaattgttaaagctaatgcattttggcaaaatatccaacgaaatcgccataacccattatgtgaaagcaatgtaccagtactgataagtgataagtcgtttaaagcacaagatttgaaagtaaagtacgaagaaatcaatcctgatgatataatgagtaatggacgattcaacgagaacgtaccgttcatgtgtaaagttgatgaacaggcatatcgtgttttctttggtgtaaagaacaatacaaccagaagttattatggtcgtaatggtgattatattcttcaatacactgatgtatttgaacgatacagtgcgtatccagttgaaattgatgctaatggcattatgacaatggatgtggatttaaacgaacatgtatcatttggtacatggaatggataccgttctcctttcttcccaccaacagaaaataaaacatcatcaactcgttactaccaagaaaaaccttgtcacgtccagctatcactaagtaataaactttacattggaaagtattatctataagggaatatacaatgagcattttagcaattcttgaaagcattaaaaatactagcagtactctgggtaaaaaagctatccttgaacaaaacaaagataatcaaacattacaaaaagtactgaaatatacactagacccttcaattgtaagtggatataaaaagctaccacaagctgatgatgtataccaacatatgacattagacgaagcaattgataagctagaatgcatttacaaacgtggtgtgaccggaaatgctggacgtgacttcattgcttcagtactgggttctgtatcagaagatgaccaagaagttcttcgtaaaatgctcacgaagaaccttgattgtggtatccaagaaaagaactgtaatgatgtgttcgggaaaggtttcatcaaagacgaaccatacatgcgttgttctttgattgacaaaaagactgcaaagaacattaacttcaaagattatggttatgctatatcagaagttaaaatggatggtcagtacttgaaccacgttgtcattaatggttcattaacttctacatcccgtaatggtaaactatacgacttcctgggttgtcgtgatggtgaaatggcaggtcttgctcacatcatccaaagtaaagatgaacgttttagtagtggtgtagtctttatgggtgaaggtgtagtactggacaatgatggagaaaccattctcccacgcactactggtaacggtatcattcagaaagctggtaaagatagcatcagtcagaatgaagcaatgcgtactgtattcgttctctgggatgttgttccatatgatgcattttgtgaaggtgtatggaatgtaaaacgcaaagaacgccgcgagatcttagtagatgcaattaacgaactcaatagtgattttgttcgtatggttggattccgtaaagttctaaacatcaaagaagcatttgagtacaatagtgaactaatgaacgaaggtgaagagggttcagtactgaaatgtgaagatggtatctggaaatctcacacttctcctaagcaattgaaaatgaaacttaaaatgcaattggacttgcgtattgttggtttcaatgaaggtgaaggtaagcgtaaaggtagcctgggttcgttacaactggaaagtgcttgtggtacattgaaagttaatgtaggtactggaattaaagagaaagacgcagaatggacgtttaaaaccatttgggaaagaatgcaagaactcattggtcaagtagtgacagtagagtgcaatgatattgtattcgataagcgtactggtgagccatcactatttttaccagtgtttattgaatttagatttgacaaaaacacatgcgacgactatactcgtatcttagaaattcgtgatagtgctgttgaggtgttctctaatagtattcttgaatcactcggttaatcatttataggaggtaattatgaaatttgttgtaacgtcagacgtacacggtggtactgattacctccatagtggtgattacagtgatacagtactgattattgcaggggactttgatgaagttaaacgcagtcgttatcgtactggtatcgaatccctgtgcaagcagttcaagaatgtagtactggttcctggtaatcatgagtactacggttcaaacattcacaagactaataaagtactatccgatatgcaagatgagattccaaatttcatctttttgcaaaacaaatttgtatggctggatggtgtactgctggttggcagtacactgtggactgactttgataaaggcaatgcactggttaagtttgatgctcaacaaaagatgaatgattataaacacattcgtcatggaacaacatcagaaccgtggaaacgtaagctcaaacctgatgatgttgagttcatgcattatcaggataaacaatttatcaaaaattcagttgacacagttcgcctaatgaatgataatgatatcaaggttgtggtggtaacacatcatgcaccaagttatcagagtgtatctccgagatacaagaatgacacactgaatggatgttattgttctgatatggaccagtacatcgaagatttgggtgctgatgtttggattcatggtcatgttcatagtagttttgactacaacattggaaaaactcgtatcatttgtaacccaagaggttatgaatcttacagtggtgcatgtgagaacttcgattacgatcctaaatttgtatttgaaatctaaggtgaggttatgatacatacatttcacattgatgacaaaatgcttgttatattgggtagctgtcatatgtatcaacgatggggtatgcgtatgctatcctcttgtgacaaaacccaatactacaatccagatggtactggtactgtgatgaaagatagatatcacttcacccgtgatgtaaaacaagcagacgatttagattcatttgtgggaaaggtgtatgttcttgttcatgatgatagtcgtggtgatgtgttgccattcagtactttatcaattaatatgttctttagatacgaacaattttcaaattcactaagaatgattgagattgattttgatgacatcccagttggtatacgatatgaatttcttcatgctcttgcgtcaataggggtgtactgatggaaaatatcgttgtgtatgtaattgagtacaatgatgaaatcaagtacgtaattaatgcgtatacacattacacaagagcagcccgaaagctggaaatatattcaaaagaagcaagaaactactgcttagatgatgattcagttgaggtttggattgatggatttgcagagtactttgatgctaacttctatgaagatcttgacaaatcaaatgaattatacatttatgtagaaaatgaacgttattacacaaattctttgtttgacattaccgactctacggtgtatgataatgctatggttaagttgttaaagattgaccacgatatgtttaataaacatacaatttgcggtttactagattttttaagaaacttgtagacaaatacgaacactgtgatataatactcacatcaatgaaacaatagaggaaaataacaatggttgaacaattcaattttggtggttatgctggtggtgaagttcgcaacatttctattccttatgtagttgaaaaagttaatggtgcagaacgtacttatgatctagcatctcgtatgatgcaagaccgtatcattttccttgatactgacttcaatgaccaaatggcacatatcatcaagcaacaattggtgtggttggattctcagggttctgaaccaattaccttctacattagttctcctggtggttcagtacacgcaggtttgggtattgctgacattgctaagtcttgtgtatctcctatccgtacagtagtaatgggttatgcagcatcaatgggttgctatactcaatcagttgttggtactaaaggtttccgtctaggtggtaagcgttcttacttcatgtgccaccaagtaagttccggtactcagggtctgattaccgatcagaagatttctttgaaacactctgatgcattgaacacactattgacgaaagaaattgctgaagcagttggtgtatcacacgaacaactactgaaagatgcagaccgtgacctgtggttgaacgctgaagaagcactcgaatacggtgaacatggtttcattgatggtatcatccttggtccacgcaacgaagaaggtaagtatctcgtcaaacgtcgcggcggcgtggaagagtgggtctaatttgaatttcatttgatgcctcatttggggcatcttatttctggagattatatgaaagttcttgtacgtaataatactgaagtcaatgatgtgttagatgattcagagtttattaataccgcattagatcagattagtgcagtggctattgaattgaaaggtgttgacgaggcagaacgagtactcaatggtttttctattgttctcgaactaatgcaagaagttcttattaaaaagaacattaatccaattaacgcagttcaacacgcagaagctatgcgtcaagaacatggcacattctcagataaaaaattcatcagtactgacgaggggaaagaataatatgtctaatgcacaatacaaagaaggttctgccgcgtttaaaaacaaagtagtttttaacaatgaacagctaaaatcacagcacccactattccgtcaaggttatcgtgctgcacaagctgaagctatgaagaaaaacaacgtaacattcccaacaactctgtatgatattcctaaacgtccatcagtgtttaaagcagaatggactgacattatggcagcaactaaacgtcctcgttttgctaaacttcacactgatgaaggtcgctggatgttgatgggtattatgaaagcagttgagaaacaggcacataccatcgttcgttacaaagacgttgtagctatggttgataaagcatttgatcttattctccagtacggttatgatgaaggtgtactaactgtatctgattgtgagcagtaccagtacactccattccagaaataattacttagggaatctttaatgattcccattttatttgctgtatatcaaaaattattgatcaaaaattgatccatacaaggtaaatacccaaggtgtaattgttaatagggtaggtggatatgcagcaatataaattatctgaagatcaaagtgatttatttttcaatcacatgtttttaattgatgaatttgccgaaagtttaaattcagaggcaatagctatagttaaaaagtggtattcttgctataacaagaacaaaaaatggtattggttgaatagaaatttaaaatcatttctaggaacaataaccagtactgatagtattgaactaatacatagttccattggctacagttacttaaccaagcataataatacgtcaatagagtctggcttcaaaatcaagcgtctaatgaaattgacgggattgagtgcggaaactatacaaaacgatacagaaaagttatggaagattacagaattcatgaataaaaatatgtcatttatatatagaaattatgatatattcactgatgtaagacaattttataagagtccatattcacttaatgagaaatatttccgtcacatggaattatgctcaactgtggttgatgaatggaatttagaggattaacatgaaatacactgctcttagcccaactgatactaaagtatggttgagtaatttgaacaaaactattattttaaccaaaaaagtgatatcaacagctaattcattagatgtaaatatcaagaagaatgttcttaaatatcatcaccgaagtaaacttagtacttggtactccaatattttttacggcttatatgggatggatgatattttaattggtacatcatctgggtcatgcttcagtgctggtggaatgtgctttatggatttgggtttttcattatccgatgaagaaatcgagtttaaacaattccgtgacaagttactgggttcgggtgatatcaagttctgtacagaattaatgggagcatgggacgtttatgcagcgaaaccatttgacattgaagaatcagatgtgctaaactaccttcgtattcttaaaatacattcgaactgtaaagccaaattacaatccctaggagtatatgatgaaacacttgacgtggttgaagatagccgaagtcgtggctgaagagagtaaatgcatttcacagaaagttggttgtgttattgttaaaaataaccgagtattgagtactggttataatggtactccatctaagcaaccgaactgctgtgacgctaatgagcacttagttaatggtggacgtttccaagactgggttagcgatgacgcaaagcatgaacaccatgaatggagtaatatccatgaaatccatgctgaaatgaatgcattgttatacagttcacctaccgaacgtcagggagcaacactttacacaacgctacaaccatgctatacttgttctaagttgattgcaggaagtggtattgcacgcgtgatttatcacaaaagttatcctcgcactccaccagaagctattaaagtactggaagatgctgggattattgtaaattgcatttatgataaggggttgtgactttgactttcttgattttaggtattccatttgcagttgtgatccttgtacttttagtgatgattgtattaaatgataatactactccaccagtgatgcgtaatcatgaagtacgattttcagcacaaaacaacaagtactacattgtaaattgtttaacttgtaaagagtataaagtaactggtaaatttggttttaccatttattataaagaccgtgttgaagctgacatgatttgtcagaaacttaatacggtagaataaaaaaaggagccataaggctcctttttcttttgttagtacacgataatttgaatttcaggaaaactcttagaaccatcaacgagttcagtactaccacgttatttgttgacaaaagcatagacattatacattagtgtgatataatcatccaaaagaaggtacaaaggcggggcgattctgcgagggaatgtgtgaagtgatttaaaaaacaatttgacttaagttaaatcttcctataatattatttatgtaatcaacaatcaactaagagggttaaccagtggcacgattatgtaaagaaatcatccaatctattattattattttcttaattaactttcctgcaagtgcaggtgatgaaagaaaaagtatcattagatatgatgaatctaaacagacagttcagttcatttcaactttaactgaaaattctgtaaaccgtttgatggtttttagagaaacacacccatttgacactatcatcattacgtcaccaggtggtgattttgatgcgggagtggcactaggaaattttgtcaatgataacaatttaacaattattgttgaaagatattgtaattcttcttgcactatcgcattctttagtgctaatatagaaaacagatacatgatgaaggactcaattctaggtctacataatgtgtcaatcgaaagtaaagcacgaaatagtgatgacacatacataacagttcgccaattgactatttttgctgaacagctatcaactaaggttggtgttctatttgcgttatatgcagcgaatggtattcctccagaattgttagtggaggttagtaaggttcgtggtaatgaagttgtgagacttacaccagagcagttgctcgaattaggtagtatcattcattagtattagatacaaaataataatattataataagaggatgataaagtggtacatcctttgttataagttaacatacactaggagtgtataaactatgacaaatttacaaaacttaacatctcttgttttttatgcaacaactattgtatattgcattacattagttttaacatgtttcatctataaagactacaaacgtggttttatggattccagtacacacaaatttgcatccaagttcgaagcaggaatttactatgttctatcaatttcttatggagcatgtttacttacactagggttgctgatatactggttgtatacggcactttttgcacaaggagttatttcatgacttgtattatcgctcacacaaatggcacatcttccttcatcgctggtgataaattaggaagcaatggtttcactaaagcagttcaaactgagcctaaagtgtttgagaaagagttcattaaactcaatgaggatggtctttctcgcactaaagaagtaatggcgttggggtatactacctcgttccgcatggggcagttgttgaattacaacctaactctaccagaacaagttgcaggggaaacattttcgcagtatctagtactgaaagttattcctatcattcgtcaaatgtttaaagatgaatggggtgctcgtgatgcatcacaagacgttggtggtggtcagttcattattcttcataatcatacgatttatgaagttcaagaagacttttcagtactgcaacctaaaacacaaattactgctgtcggaagtgggacttatcatgcaattgcatccatgtcagcgtatattgaagttcaagaagaaaccaatgttcagttacatgaacgtgttgagtctattttcaaaattgtcagtgataatgtaacaagtgttagtccagagtttgatattttgaaatactgagaataataattataaagagagagtatatctgatggcatacatagtttacgagtggattttttgtttcatagttgtgtttatttgtgtggtgttatacaatcacactaaatgtttataccgagaattcaggaatggtaataaacatggacacaataagtggatgtatgtctatcatattgctatcattgtatttttagtattaaacttgatactttttatataaggagtaaatgtgatatcagataaatttatacaaaatgctgggaacaaaagattacttataatttcaggggcaggtctttcagttgagagcgggatggaaccattccgctttgatgatgggttgtgggacaatttcaaaattaatgatgtttgtaacattgcacgacttagttctaagtatcatgtagttcattcattttataatacattgcgtgtaaaattaggtgaatgtcatcctaatgaaatgcattactttattaaatcattagaagatttgtatggtgattgttttttacacatgacttctaatatggatgatctatatactagaattggtggaaccgaactcaaactacacggcaatttatgtgaagtaattgagaacttttctattaatactgatgattacaatgtcattaattgtggttatgaaccatatatccctaaagctgatgtttttgcaaaaccaaatgtagtgatgattggtgagtatcatcgctacgttgatggggtacgtctccccatttatgaagaacgaaatgaagtgttgaaaagtctcacagaaaatgatacagttgtagttattggaagtagtgatacagtactggtatggtccagactagctggtgcacttccatgctatagtgtaaatgttaacatccgaaaaaatgataatgattttctttttaatgagaaggtcatcaaacctgcgacgaaagcaattccacaggttgaaactataattaaggaacgaatgcgatgagtaaagcggaagtaccactggggcaaatggggaaacgtgcaaattttgtattctgtttcttttatgcaaaagaatgtaccccatacgctggttatgaactaaatgatatcccagtggttaacttagtactcctacaagtgcgttgggatggattgttgggtgcatgtggtggaacagttgaaagtactgataagtcattagaagatgcgttacagcgtgaagttcaagaagaaatgaactatatcattgacaaaagtcgcctgtctccattaaaatcacttgaattgtttccagagggacactcacatagctatagttatgaaatgacttatgctgaacttaaaaaacttcgtgataattatgcatatggcaaacatgctagtgcagaggtggctggtgtaaatttatgtcacatctcacgttattctaagggacaaaatcgagaagcaggatataataatcttatgacacagaacttcatcggaactgcgaaacaagaattggagtatcttgtacaaaaagaaaacttactaatcaactatctataggagtttaaaatgtcgtactcaatgttcttggatgatattcgtgattatcaaaaatattatcctgaccaagagatggtattgtgtcgtgactacgaaagtgcatgtgaatacgtaatcaaaaatggaattccagcatttgtctcatttgaccatgacttgggcgacttgagtacagatgagaaaacgggatacacttttgccaaatttctaattgattatatgtttgagcataatattaaagaaccatttaaatactatgtacatagtagtaatccagtagggaaagttaatattgaaacttacttaactaatggatttaatgcactatgatttcaacacatatcaagagtcttatttgtacaacgctattaggtataggtgttctgtggttcagttcatatcatgagaacactaaacgttataatattcattacaatacagcgactgtaacaggattaggtcaatgtaatgaaaataaatgctcatttacttataaaaccagtactggtgaagttcgtaatgggttatcaagagatccagtatccattggtcaactagtttaccaggaatgctgggaggaaaaggctcgtggttcaagatgttatgttgaatacgaaccgagcatgtaatattccgagtcactaaccattagtcgagtacaaggatgtactcataactcaaggatgttttatgaaaaaatatacaattgacacaaacgtactactatctgatccaaatgctaccattgcttttgatggagcagctatcattctaccgttcacagtacttgaagaattggattcaatcaaaagtcgtaatgtggatgtttcccgtgatgctcgtgttgcaatccgtaacattgaagcaatcctttctgatgcatcacatgaagaaattagtagtactggtgttaatattgctgatgttcatactaatatgagtcctgaaagtaaattgtttgttattacaagcgaagaagctgaagcactaattcgtactgctggtaacgaagagaaagttcaaactcttctaaaaagcacagtaccagatgataaaatcattttagtagcattagcaactgattcagtactggttacccgtgatatcaatatgcgtatcaaggctctaagctacggggtggaagttcaagattatcgtcatgatatcgtgattggtgatagtgatttgattcacattgggcaacatcaccttgacctacatttctgggatgtgtatagtaatctgactgatgtatctattcagtctgaacaagttggtcgtcgtttgtaccactacattccaaaaagcttgattgaacatatcatgccacaaaatatttgcatcggtgattacctatatgataatgctgatgttctatttgtgtacgaaggccaatctgcaattgaagaagatgatggtactttaacaccagaagatattcttgtattccaagatattggacaatctgttgctctacgtgctaaagtgtgggatattaaggctaagaatattcaacaagcactagcaatcaacagtatcctagatcctgatgttcatctaacagtactgttaggttcagcaggtactggtaaaacactaatcaccattgcaactgcactagagttagttctagagaagaaaaaatacgaccgtatcatcttctccaaaacacaagattcccaattcgaagacattggtttcttaccaggatctgaagcagagaaagtgattcctttctgtggtgcagcaatcgatgcgttggaattcctacacaaagatgatgctaacccacaaggcagtatcgaagaaatcatgaaacgcaatgttatccagttcaaagcactaaacttcgttcgtggtcgttctttcacaaatactatcctagtagttgatgaattccagaacatcacacctgctcaggcaaaaacaatcttgactcgtgcaggaatgaactgtaaagtggttattatgggtaacttgagtcagattgactctaagttcattagtccagtaaacagcggtctaacttatgttaccgagaagttcaagaactgggacggttgtcgtgtaatcgaactagaaggtgttgttcgttcaccactggcagaatttgctgaagaaaatatgtaataatgtgtgggacattcgtcccatacatgatataataatgttattaacaacaaaggagaaatactcatggcaaagcaacctaagaaacaagaaccagtagctaaagttaagaaagttaaagttattcaatctaaagaacaacgtacgttcgaactacgtaaagcagaaaccctaacaggtcttcaagctctacgtaaacaaggtgttctaactcgtgctcaataccgtgagctagtagcacaaaaaggttattgattcatttgaagcaataaactggagttcatgataaatactttcataagaataataatactttttattaatttaaaaagaactccatgtgttatttcagtttttcatccctgtcttttggcagggattttttctttctagatattgacaaaaggattaaactatgagaacatgtattaaaggacgaatgacattccattaggttagtttaacttaaaggagaggatatatgttttttgaccaaacatttacgttgtaccatgattcaggtaaagttgagattattgataatctgttagagtacattgctgaacatgacggtatagaccgtttccacagtaagatgaaatttgatttagctgaattcaacaaaaagaatcgtgaaacattttggaagaaccgtttctattacgaaatgtatccagaaaagttcgtaggttattatctttgtactgaaaaaggattacttgtatctcctgatttacttatgggtgaatacatgatactctataatgagtactgggagcataaacgaaatgctcgtgacactgaatggcgacataagcgttcgtatatgtacaaacataaccactcccgatacaaacgtcctaagacccaacaagagcgtcgtatggcttgtgcagtactgaaggatgagggggaacctgatatacgtggaagacgtaagatgcgttcactaccatcgtattgggatgatatcagaacaagacacagtactggctggaaatacagtactaaacgtaaacatcaatacaaagggagctaatgctccctatttttataggtgaactttatgaacaaaattgaagttgctgtcgtgattggttatattgaaattgaacagtgtggcattgatacctttattgacactcttaataagtaccgttcagagtacaagggatacattagtctttcaccagacggtggttacggtggtttcgatggatacaatgtaatttggaccagagaagaaactgacgaagaataccatacacgaattgaagctgaatctaaaagatgtgaagaaattgaacgtcaagaaatgaaacacttgatgaacaagaaatcattaagtaccgaagagaaatctaaactgctaaaatacatcaaggattacatgtaatgaaaaatgtatcacaagaaaagattctgtaccttgcaaagtacaatggtggatttaatattaccagttgtgaatatcatggtaacatggctaaaatgattgacgagctactagaaggtaaaatgctccgttgggagacaaatgacctttggtacgaatatgcgggtcaacaatgggaaagtgactacgataatgcaattcatacgtatacaattactaaaagtggtgaagtacgtttggctatcatgcgttgtgcttacacttacaaaaatttcaaagatgaagaaaagcatattcgccgaaatgaagagttagtacacctaatgggtgaagctggcattacaatgcatgacttgttcaatgaaccaagatggactgggaatctgaccaaagcagaatacaaagcattgcgatacattcaagtaccagaaatcaacaaaccaaaagaatgtattgatgatggagaactaagcctcaaaaatgtatttgaaagcaccagtactgaaagtattgctgatctttcagttcagatggctatcaaagctatggaactattcaaaacacaatatgatggtgttaattcagatgaagtagagcgtgagttcattacgcgagtacaaattgcattacataaatcaaaaaagtaggttcatatgaaaattttacttgtactaatcgccgttcttatggtattatcttgttcagttagtaatggttcatacatttacgtatcagtatttgaagaagcaccaacgaactgtgtattaactcacactggtattgtgttagttaatggtaaaccatcaatcgagtacttatgtataggtgattaaattatgaaatttatttctattgcaattgtttcagcactcatgatgttagtaacaggatgtgcacctaaagttcaggaggctgatgcagagttcattcgccagaatttgactaaacttaactacgatggcacattgtatgcttgccatgagatgcgtcatgggcaagatcttaatctcatgtgcaggaagattgtgaatcgcaaacgtcttaatactgttccgaaggatgcacaatgaaagaagtaattggttacaaatgtaaaaattgtggcaaagataagggtaagcattcagtacaagggatggcttgtccaaatccaggacgtggtaatttcagagggttcagtactgaaaagtcttacgaaccggatcataccaaacctgtaatgggttataaattatgagtgattatgtggcatttcttcatcgctttggtgaagctcaagaaaaacacattatccgtatgccagcttatggtgaagaagactggtacaaaagtactatcagtgtaggtgcatttcgtgaccgtgaagctgaattctttctgggtaagcaacatgaacgagaggtactttgctcactttggcgtttagatgaatgggatagtgataacacacgaacggctgaaacgatgctgacagttgttggtattgcgaactatcagcacccatatgatctattacctacatttgaacatgcttctttgtttgacttttacaaagcagtagggtatgattataaaaagaaacgttacatttaatatcagtactgccacagtgggcagtactttttaattggagattactatgactacatcagaaaagtactggtggattttgggccatcctaaattcatcaacagagatatggttcccccaaggattgatatcgaaccacatgatgtgtgtccaatcacaaaccgcattgaatcatttaaagctctgaatacaaagacacaattttgggtagaattcatctcacctatgtacgttgagcaagatgatgaatgggtacaagcacatgattatgagttagattgcggtggtgatacttatgatgaggcaattgatgaactatacaaaaatgtgctaaacacttatggtgattacacccaacaagaagcagacgatacgtttaataagatccatgcagtcatttctacatcatcaatttacaatacagcaaaaacagtttgggaagaacgtcacgggtggagttcatctgtaattgatgcagaagccaaagaaacaattctcgaagacataaaaaatataaaaagtacaatagaagccttgcgtgaatttataaagtcttgtacaatagaacaacagaaagaggcaaagatgcatttggagagtgaagaatgtaaactttgggttctagagaaatcatttgaaaagggtatagacttagacttatgaatcgtaaacttgagaaactaattgaagaattacgacggatgccacccatcgagcaagtggggagctacaaacgttatcgtgtgattgctcgtgcactagataagaaaggtcgtgtattggcaacacgtactaattcttacacacatactcacccagtacagaaaggttttgcaatccgtgctgggcgtccacaaggtgaatttcttcatgctgaaatctcatgtttgctggcttctcgtgctgaagttcatactttgttgattgcacgggtaagtaaagatggtattccagtccctgccaagccttgtgagatttgtacgttggcaattctggaatatggggtcaaagaaattattcatacatgaagaaaatcgaacgctaccaaaaccatacagttgtgactgaagatgatatattttattattatattttcagacccacacactgtttacaaataacgacatatgagaatggtaaattcaaagatgtcaacttccatataacagatttagcaaaatattccagtactgaacacttttccaatttagtatttgtgtactgtataccaaatcataacatgtaaggagtcaacaatggctaaaactatttctttaaaaaatgaaaatgtaggacaacgcaaagatgggttctttggattctcatggacaacattgttctttggtccgttccctgcattgtttcgtggtgactttattacgttcatcggtgcatttgtaatttacttcatcctcaacgcagtgtctttttggattgtgggtacaattgcaatggtcgtgtgggcatttctttataataagtactacactgtgaatctcatcaagaatgggtataaattcaatggtacacatgaagaaaatgctgaagctgcaatggcgttacaaattgatctaaacaaaaacaatacagtagataaaaacaaagaaccagaataaatggatcagtatgagataacttacgattattatggtaaggcttatatgaagtgtggtcgttttgttgaactatcaaatagagaagcaatcgacccacaaaccattatatccatccataactcgtactataaaaaaattaccatagctaattttgcaacatacgtagataatcctatatttccgtatattattcatttctattgtagagctataaaataaggtaaaaaaaatgttagccgatgattttatgtctctaagtatcaagatatttgatatattaggtgatgaaatagatttccatctaaatgataaaactataccacacgaagatggtgggtattttttcgcatttggtaataagttcaatgttgatttttcaattccggttcctgatggaagtgattatgcagcatcaacatattttgaatttcagttcagtggtcataccgagcgtttactaacatatagacgtaaaggaaatttcagtagaccagagattatattaatggattttgaaaaacgcatagaacttgcaaagaataatccattcatcagtacttatgcgttaaaccaattcattgatctatttgatggatatccagacagaatacgagggtcgttacgtataaatgcagaatgaaatatttaaaaaagaatacgatggtgaaagtctctatgatattcagcgagacgtacatgaagcattcgattcaagatttaacccattagctggacaaatcccacaagatgagtttggtttccaagaaggtacatttactgtgactattacatggagtccagatgagactagctaaacttgtaatcggatgcagtgcacttgctgcatatatgattttctctgctccaaccaatgtagtactgctaatttgggcagttgttatattagcagtactttaaagcaccctagaggtgctttttctatttgtgcaaataaaaagcaatgtgacctttccttgatatagatcaatagaaataccctgttctgacgctataatggtgtctggtgatgttaaataacttcacccccagatgatttcaaaatacaaggaaagtaaaatgcaattagataaattatatactgacgtaacaaatttcctaaatcagagcaatactgatcttacaaatgaaaatgcaaacaaagatgcgaaatgcgtcaatacacacagggatttacttgctggtatcctatctaagcattattcacaagatgttattccaaaggagctaatgcagtggcataatgatggttatggtcacattcatgatttagactactatatcagcccattaactaactgttgcttggttaactacccagatatgctaaaaaatggatttaccattggttgtgccaaaattgaagaaccaaagagttttagtgtagcatgtacagtactgacacaaattgtacaagctgttgctagttcccagtacggtggtcaatcgttggctcatatcgacgtgggtcttgaaccttacgtacaaaagtcgtgggataagctattagcgaagcaaaaggcatataatctcagtactgaattcattgaggaagaattacgaaaagaagtctatgatgggtgtcaaaccttactttaccagacaaattcaatgattagtacaaacggacaagcagcattcatttctcttagtttaggactgaatacttcaaaatttggaaaattaatcactgaacagtacttaaaagtacatgagaatggtttaggcaaagataagattactcctgtgtttcctaaagtaattttctttttacaggacggaatcaacatgaatagcgatgattgcaactatgacatgaaacagttggcaatgcgttgtgcatcgaagagaatctacccagacttcgtttctgtgccgttaaatcacaaagttacaggaagtagcagtacagcagtaactccgatgggctgtcgttcatttttaggaaaatgggaagattccaatggaaatgagcaatataacggtcgtttcaacttaggcgtagtttctatcaatttacctctaattgctcttgaaagtgcctcagatggagagttttttgataaaatagacgagcatatgaatattgcatatcgtgctcagatgaaccgtgtagagcgtttaaaaggcacaaaagcgaagcagaatccgattttgttcatggaaggtgcactttcacgtttaggggcagaagaaacgattgacaagctattttataacggatatgctagtattagtattggttacgttggcttagttgaatgttcagaaattctgactggttctatcagtaaggagttctgtatgtcagttctgaattatatgaaagtaaaatgcgatgagttcaaaaaagagagtaatatagcttttagtctatatggaaccccagcagagtcactttgctacaaatttgcacgttgcatcgaatctaaatacccttcagtactaaaacgtgattacatcacaaattccttccatcaaccagtatgggtagaaagttcaccatttgataagtggagttacgaagagggatttgcttacctcagtaatggtggaaacatcagttatgttgaatcacccaacctaagtaacaatattcaagcacttgagactttagtcaattacgcttacacaaagattccatattttggcatcaaccagccaattgaccagtgttacgagtgtgggtataaaggtgagttcagtgtagataaacacggttttcattgtccagtatgtgataatcgcaatgagaagacaatctcagtgattcgtcgtgtttctggatatttggggaacccatcgtctcgtggattcaacaaaggaaaacaacaagaatgttgtgagcgtatacaacacaaataaggtacattatggatttaaagccaattgtggttaacaaatataaagaaccgtatgatgtgtatatcgggcgtgggtctaaatggggaaacccatttacccatatcagtgataaacagaccaaagccgagttcattgttgctacaagggaagaatcaatcgaaaagttcagagaatacattattgagcgtatttctaatggagaagttaagattgatgatttacttgagttagcagggaaacgtcttggctgtttctgtaaaccgaaatcatgtcatggtgatgttctcgttgagatagtgagtgcaatattagatgaattaccagacgataattaaagacgaccttattaatggggagggagtaagatgctccctttttgttagtgggtgcagtcatgggtgtgccggatgcttcaacgaagaagcatgggattatagaagtggacaagagttcagtactgatacaattgatataattttagctgaactcagtaagccttacgttagtggattatccctccttggtggagatcctctaatgaaaaagaacatagaaacaattttagaactatgtaagattgtaaaagagacttatcccaataaaactatttggtgctggagtggatatactttagaagagattatgaataatcatgctaaagacattcttcagtacttagatgtattagttgatggtaaatttgtttcagatgaaaagaatttgacattaccttttcgtggttcaaataaccaacgtattttatataaaaataaagacttttaaacacaagcacccaatgggtgcttttttagtacattcataaatacagtaactaatatctaaattacaagggatatgtatgtcaaagaaaatatatggtggcttagacgtcactcataatgtgacagttaaagggaaaagaacagtacagggcatcaatgatcaagtatttgatgctaatggtaatatggaaattgatacatattccaaagaagaattacttgatgtaattagtttacttccaatctcgcattatggtacacataactatctacctgctggggtatctggtgattttaatggtgcatcagaaaaccaatcccaacgtagaaacaaaatacttttagaaaacgatggcacattagtactattacgtagtggtacaaacggtagtgttgaaggtttgttttattcttacctagcgaacgcattatcagttaccgatatgagtcgtactgttaatacaagccgtcagtataagcctggctatttcggggcaaaccgtgttgctattggtttatacaataccgattcaaaaatactgttaggtcgttacaatgacacatctaccagtactaatgggttgtttatatcagtaacgaatggtacattggatgatacacaacatagtggtctttttgtgaaccaagctgatatttcacctgaaggtgggattgagtatgctatgatggcagaagacggttcagtttatgtattcaacgtccttaatgaaaataacaaactacagattgttgttgttcgtgttgtgttgaatattgcaaacggtacttatactgctacccgaatcacggggtggacaacaaaaactttttacaatactacatatactgctcagaataatatgatcattactgaccatgttacatcaacaaacattgcagataagccatatgtttatgtaccacagaatttagctggtattggaatttacatgacctcaatcgatttgtatgttgctcaagagccaggaacgcagaacttccgattcagaatgaatggtgacgcatggttcactatggcaaactacaatacccgaccacagcatagttatagtttcaattttaacatgagtactaaacaatgtaacttggataatgggaacgatattggtacatttgctgcaccatttgttgttacaaacacaggttcggcattggttgctactggtaatgttctcaacaacgatccgttatatgaccacaacggtgcaagaaacatttacagttcatattattatttgaatacaggtgatgtattctgtactgcatgtccaaacttagcagaaccattgcttatgcagaaagctaaatttactgcacaatcaatatatagcatgattaatgtacgtgcgaacatttcaactgatttcagaaatggcatagttcgtccttcatttggttcagcagttggttcttttgttaacggcgtagaattgcttccagggaacagcactaaacagtattctcgttcatctggttctggtgcattccgtccatcttatgcagttcataaaagtactcctaactttacgtttaattctttatcacgtggaaccatacaaggttatgagccaacaacagaacgtgctaatgtgacagataacacgaacaacagagtttttattagttccattagtggtaataatgttactacaaatggtgggatattcatggtaggtcagagatattcccaatcactatcatatgataaaaatatgaacggaactggtattattagtgttactcaatcagtacttgataatttcagaaatgctgaatacgctaaagtactaagcgactggaacttatctcctgctgcttataaagatatgacattgtttgttccacaacaaactgatatacctgcattcgtaatgctaagtacagttacaaatacatatcagaactatattagaattgctgaagtgaatgtgaatacacgttcaggtaatatcactacaattaccttcaagcgtttagtactagaaaacgtttacggaagtaactttacaccaaatggtaatggtagttttgcatcgtcttctgttggtttgacaatatatgatggtggttctttctacttcataggtggttctgacccattatctcacccaactattggtaatacaagcacacaccaattcagagcatatgtaacaaaagcaactgcacaatttgatagttttattatcagtggttcacatgcaagttatgagcaaggtattcaaccagcagctttacctggtattggttttggttatttccaagcaatagactatgtaaacaaaatgactttccaaaaatgtggtactacaattgctgattataataactggactgctcaaggtgcaccgattaacgtagtttcacaagacgttgctcaaggttttattgtgtacttcacagaagaaactccagtaattctttctggtaaagcatttacattaccgattactagtataaacttaactacagttaaggctaatccagcaaacacattatttcatgtatatgttaaaatggaacaaggtaatgcaaaatatgtaataacaactgatgttatttcagagactggtactacagcatataatattttctggataggtactatacaaacaaactcactacaaatatcgaatgttaacatacaaaaacgttcaagattggatattttcggtgcgtcgcttgaagctgctggttcttcattcccagttagttatggtctaccgtcacaaacaggaacaatcaattggtaaaggattaatcttatggcatatattataagatccgatatcgaagctatgtcacaaatcgtagtccagaataaaaacactggactatctattagtgatattaatgacgtatcgtatcgaacagacgcaaatggggaatgtacattccccctcttaacaaaagatgaagttgattctattgttaacggtttaccattatcacaatatggtgaactttatgatgtatctagtttgtcaattacatcaagcggttattcattacgttttaaccgagagatacctgcattcatcggtggctatctttataattaccctgttgttgcagtgacagcaccaacagtggcatcaggaacacaaacacaatatgtatacgctactttagtactgggtgagccaatttatagaatctcaacttcacaactacaagaatcacagattataatgttcatcgggactattaccgttggaactgctggtattactgctatcaacattgaacgcgtatcacgattcaatacatacagaccaagtacaacacaaaaaggttcatctttcccagtcagtactggaaatccaacacaaactggtacattagactggtaattaaaggaaaaagaatatgtcatccaaacgcatcattggtagtgctgctatacttggaaatttggcaattggtggaaagtacgctatgcgtacttttaatggtacagcaccagacgcaaatacaggtattgttgactatccaatttataaaagatcagaagttcaaaaaatacttgatatgttaccaatctcccgtataggggaaatggattatctaccattaaacgttaatggttcatacgaaggggcaacgtctctttcagatgtataccgtatgcaaccaacaatagtcgaagatgatggtactggtgtggtattacgtgctggtacaaatggtagtactgaaggatattactatgcattcattcgtgatttgcgtaatattgatgcactaacacaaagtagtgttatcagtactacatcaaaatatcatcctagaattcttccaagtactgaaaatgttaaacagttcatcggaacgaatggttatgaattactagttagcctatctagtgcaagtaattatattttcactttaacaaatggtacatttaacgaagttgcacatattcacgcttctatcgctgctacatcatttggtacagataaaccattgtatgcacatatcgttaatgataaagtatttgtgtggtgcaaagacactactatagcaaactatggtttggctttaacattatatactgttaatacaagtagtattaaagatggtactatgagtacttttgctaaggttactggtttttctggtcaaaccttaagaagtgttaactacacaagtgctaataatttgaaaatttatgaaagattatattcagttggaactagtagtgattcattatttgaatgcacttcaccagttacacgagttgaatattcagattatacagattataatatacaagcaaacgtaagtccagatttatcaaagattagaattacattattcccaactaaccgtttagtatcaaatctatatattagtactgtttatgctagtggttttagttttgtttatactatcaactctaaatcattatcaattgatggaagtagtagagcaccaatagcagcggaatataatgatgttgatggattcacattaacaaacccatttgccattgagatgaataacttcatgggtacacagttaggtgttccacaattaggtaacgttggttctatatgccaaacctatgacggtttagtattcagcacacgtgctcgttggagttcatctgaaacctatggtattcaggtttataacgtaacaggaacaccatatgatagttgggttgccagtactcgtaaagcgaacaattccaaatttgtaaacgttgcaccaacatatggtagtgcagtaggcgaaaaccttttaggaacacgttttattgataaacgtaaagtactgttagcatgttctggaacatatgaagatgagtcatatggttataacaatacagtattttctgaaattggtactgatccaaccttccagttcaattcagtacaaaacaatacaacacttaatggttttgcaccacaagctaaccgaactcgtcttggtgatgatttcaaatatacaggtatgatttcactaattgatactgacggttcagttaaatgttatgggacatcattcattgaaggtgtatacaaaacaagtggtggtttgtttaacccagatactttagaatttgatggttcttatacaattggtgataatgttctggaaacattaaaacaagaaatacttgctaatattggaatagtaggagcattttctggtaaaattgctttatattatgtaccagatagttctttctcaaaatctattgcggtggtttctgcatataacttaggaaataaccaaggttatgcaatatattctgaagttgatgtcactgtttcaggaaccaatattagttctgcgtctatggtgagttctagatacgaaacacttaattctgtaacaggtattgtaaccgaagcctatatgaaacgctgtactggtctaactgttgctaagtattctggttttggttatattggtgttgatgcagttcatcagttttcacaacctggtaatgctcaattcaaattgatgattgctaaaacagtgaatggtttgattacatctaaccgatttatgtcatccagctacatagataatggcaatgcattccagcacggagttataccaggtgttggatttggatactatcatcttcaagattcagattatcaaactaaagcagtgtttagtctctttgggacaacatcagcacagatggatgggttgattgatggttcaggaactgtacaagataaaatcgtagtagtttcacaagatgttgctgaaggtttcactgtgtacttcacccgtgaagttccggtattccttggtggtatgtttgatagattagcgattcaaaccatagaattaagtactattaaaactaacccagctaacagtactttttatctttacattcaaatgaaccgtaacacaagaaaagcggcatacgttatcagtacaactcttcttgatgagacattgacaaacgtatatgttggtgatattgttactggaagtacgagtattacgtcaattgatactgaaaaggtaacccgattcttgacatacagacctagtacgaccaagcgtggttctgctatcccagcaagtactggtgttccttcaagctctggtacacgttggcattaaaaattttaagctcgtctattgacgggcttttcttttatgtgtataatgctagaaaatacaggaggaaattatggtcaaatctttactaccaccaccaaagcgtcacaaaatccaagaaatgaaagaccaacgtacattaaagatgtacaacaatttagttaagttactgtgtaaaagtccatcgctcaaagcagagtttaaaactgatgatgaccgcaaagcactaattgagatgaagtatatgctcagtaaaatgtccttttacaaatttgtaaaagaatacgcatcagacccatttagtcctcgttggagaaccaaaccaagagagttttttttcggtggttcatatactgatatcattcaagatactgtgataggcgtagagttcgagattgattatgagccgaatggtgtggaaaacttgctgattgagaaacgtttaccaagtgaagaagaaatttatgtttatgcaagaaaactttcaaatttcagttcaagaattactctaggtaatttagattcatttattattttctatacacgtgttggtgtagataaaatgataactaaactcaatgaactttcattacaacaaaaacagattaatgcatacaaagacattactgatttatactaatgaggaatgaatatgttttttggaccagttggaaaacaaaacagtactttaatttggcatgaaattatctttaaaattatatcaaaaagtttcacacttaaagatatcatcaatacagatcaagatcgtcgtgttctgttagaagcaaaatataaattgagcaaacaccctttgctaccattaatcattgattacgttaatgattatgaatccagtcgttggaagtttgaagaaggcggtttatttcgtggaaaaacattctacggtgcggaacgatatgtattcagtgatgcaacaaatggcgttaagtttgctattagaaactttaactccaaagaaaatgattatcttgaaagtggagtgaaagtatatatcgataataatagcaatgttctaacatatgacgaatcactaattatgttacaaataatgcgtggcgttgaaggtgtaagacacaatcttactaatttgaaaattcagcaaaatgatatacataatagacagaaaattaagggtttatataaatgatttcatttttcaaaaagaaagaaaaagttgatgaaactggattagaatcgtttctatggactcttatcatcaaaaaaagtccattgataaaagaatatgccatcaatgatactaatagaaaaactatcattgaatacaaatacgaattatcaaaatgtgatccgattgtttaccactttgtaaagtactgttctaaaaatttatcggatatcaccattgattatgagtcagtaccaatgagttttccttatggagattgggtaaatacttatgatatttttgatgggtctaacggattcaatttttatttcacatcaaataaagcatatgttcgaatcaaaacagatataggttgggcattacatagctcaaataaagaagattataatttattagctgatgtatacagaagtgttaagaattcaaaggatattgatgaaagaattaaaaagcaaaatcgcatttctttatctttagaaacatataagtcaaagtacggtggttaattatgactacaatcgatgatatctacagtactatacgcaatatgagtacagatagaaaagtctttggtgacaaagaaaagtccaaatgttatggcatcgattcttttgatattatttcatacgaatataataacaatgggacaagttcactaaacattgtgtgtccacgagatccagaaaataatttcatgtacgttgaaattaacaatgatggtatgttctttactaaagtatataaaggtgggaaagaatacgaacccatcgaagtaatgaatgaagagaaattcttccaagaagataccatcatcaatcttggatttagttacaatgactatcaagtactggatcatgattttaaacgatactataatggttttctaaaggagttaacgatttacttatgaaaaacaattttctagaacaaactattgtgaaacacttagctggttcacaggcgtatggcacaagcacaccagaaagtgatacagattatcgtggtatcttccttgcaaacaaagaatatatcctaactcctttttttaatgttaaggaagtttcagatacttctgaagaagatactaaattttatgaaatcaatcagtacttaagtctgtatactgaagctaacccaaacattcttgaatcactatgggttaaaccggaacacatcgtagaaagtactgaaatctatgactatctacgctcattcaatcagcaattattgagttcaaagattgcacactcatacagtggatatgcatacaatcaggttaagcgtatgtctaatcaccacggctggctcgataaggaacgaattgctgaacgtaaactaaatgaaattttagaagaacatccagttgacgaagtactttcatggatgtatgatacattcccgcagtatttggttgaccgtttgaataaatccaatcttcacccattcaatgctacaaaaattgattttgaaaaatacatgcgtgatacttcattacaattagtttcaacacaagcattgaaacaatatcattttgtacgtttagtacataattatagtactgataaagtattagatcgtgatttcaatttattgaattacaattctggatatgaactaatccattacggtgaaaacatctttggggtaattatcaacccgaatgaaagtacagtgaatgctgatggttcactacgttacttcaataaagaacgtacttcggaagaattaaaagttcgtcctgaactcattgtaaaattcaatgaaaaggaatacaaagaaaatagtgagaaccgtaagagttatcacaaatggaagcagaaccgtaatgccaaacgtgctattcttgaatcacaccacggttatgactgttatagttttgatactgaattcttaactaaagatggttggaagttatttgatgatattactgaaaacgatctattagctacttttgacaaaaatcacaaagttgaatatcagaaatacactgaacgttttgataatttatataatggcaatctataccatttcactggtcatcaccaagatactttagtgactgctaaccaccgaatgtatgttaaggattatgcacgaaatcaacaaaaagatatgtctgattggaaatttgtagaagcagcacaattaaaagaaacatataaaattttgaatacaatatccccaataactaaagaacacaaagataaaaaaagtccaattgactacatggatatcaaagtttatcttcaactcatggggtggtttatttcagatgggtgcataaatttcagggatggtaaagtaaaatctttatatatttcccagtcaaaaactagtcaaggtatgcgttgtgctttatcaaaatacaaaaaatctggtcaattaatgtttaatgaatacattatagaaaagaaagattatcaagctaatgacgaatcaagatatacattcccaagtgaagtagctgaagcattatataatgattgtggacatggttcatataataaacgaattccaaattgggtatttgatttaacaaaacgtaaaatggatttccttctgaaaggtttgttacaaggtgatggaacaaaacgaaatttagttaatgacaatgatacatttgtatattatactgccaattcattattagctgatgatgttcaaaaactagcattactatgtggttatgaaacatcaaaatggggaccatacacaaacgaaaccaattttggtagtgttgatatatatcaaattcatatcaatatgaaacccaaaaccgaaaaaatgaacatgaaacaaaatcttgaaaaaattccagttactaattacagaactgtgtgtttttctgttcccaacggaacactcattactcgtagaaatggaaaaaccgcattacatggaaattgcaaacatgctatgcatacaatcaggctgctgaatacagccgaggaagcacttgaaactggcatcatccaagttcaccgaccagatgctgctatgttgatggacattcgtaacgggaagtggttgtatcaagaagttatggattatttcaacgaaaaggttgactacatccgaaatgtggcgtatcataaaactcatctaccgaagcgaccgaacataaagttggcgacaaaggtactattagatatccgtgaaatgcaatggtacagtaaaaaataagaggattgttatgctaaacgaacaaatcaaagacgcactacgtgtactgaatcgcgaagttaaccgcatccagaaaagtactgatcgttataaactaatgcatgaacttagactttcgttggaagctatcaataatggtgaatggtatcttgagccagaatatcgcactcgtgaactaactgacgttgaaaaagcaattgtcaaattcattacaagtcgcgacaaaaatgcatcagagaaagatgtatcaatgaacttccatcttaagaaatgggaaattgaagataaatttaaattcgattggcttgactggcttgaaatgatcatggaacttgaagaagaattcaaagttgaagttgatcaaaagtacgaagataatgatacaatgctatgtaaactcgtagatcatattcaaaaaatgttgtaaacatataatatagtacactctaaataatattaccaactataggagatgttattatgagtgtactagaaattattgtttcaaaagttttaataccatattggaaaccaattttggtagtaggagtaatggcaggttgtgtttacggtggatggtcagcaaatacttattatactggttataaagaaagtattgaccaaaaaatagaaaagaaagttgattctgcactcgctaagatgcagcaagaaaatgcaaaaaactatattgaaaccaaaaagataatgcaagataatgctaaagttatcgagacacaagtgcctattatagtagaaagagaagtttacaaaaacgtatgtctagatgaagatggtgttaaacttctgaatgaacttaaacagaattcccttgcagcgaggaataaattcaaatgaaatacgctttagtatttgcaatttcttttcttttaattagtggttgtgctcaggaatttaagtatcaacctaagccaattgtagaacaagaaatcttacttgaacgttgtgacgaaaatacaccactaccaagtaaaatcatggtcgataaaaacgggttcagaggatatgatggtgctgaaattcttgcagtactcgtaaaatgggatgcaatgtacaatgactgtgcactaaaacatgatgcattaattaaaactattcgtgatttacaaaatcaagatgttaaggttaaaattaaatccgaggattaaaaatgtcaaaatatcaggtctactatgttgccaaactatcacttcttgatgagttaaatcaaagaagtacacagatgaaacgctatacatataacggtgttactttccgatacttcccacaaaaagtacttacattcgttaagaattgtaaatgcgttgcgtgtggtattgaagccactgaagttcgcattgagcgttcacatagcactgatccggtatatggtaaacctcacttaaatgtctatgcagtttgtggtctatatgaagtactgatgacagtagatcataaccaattagcatctaagggtggacctgatttagagtcaaattacaacaccatgtgttcacgttgtaacagtcttcgttctaataaaactgaatcagtaggtgaattcctggaaaaagttaagggtagaaatctactggaagagcatatgaatgattttttcaataaagataagaagaaatctaaaactcctactccagaagaattggaagaacgccgtttacgtacagaactatgggaaaccgaccatatatggcatgttcgtgattttggacgacatatgaaagctctaaaaaaagaacaaaagaaattgaataatcacaattaatgtgttatgatagggacttgagaaatcgagtccctatttttttggagaaaataaatgaaatctaaaatctttttaccgcagttaatgtggcatctggcagagttagatgaagatgatgaatatactgactatggtacatgggatgacagtactgaatcattcaatccagatgttaagtacaaaatcattagtaatgaaagtaaagggcatagacgatggacagaagaatttgatctagtttttcttgacatgaacacgaacaaatattatcattgtacgtatgaacgaggtttaacagaagatagaccagcagaaccattcagaaatgaaactgatggtgttaagtgctatgaagtttctgttaccagagaagaaattatcacttatcgaactttgtggaaatacttgtaatgctaaaagaattagatttttcaaacttagaaatcatcagtgctgttaaaaatatctctgactttggtgatgagaagtcagtactggtaactgttacattcgtcaaagaacaggatagctatagccatttagatggtattgaagaactaattcacaagactaatctacaaaacgatggtaaactcattaagcttcaggcttcctatacgcaaaaatcgtcattttttgtagacctaaataatgtagtcaaggtggtatacaatcaccctgaacacaaatacaggaacacgacaagaaacgagaatgatgctatagactccaatatcaaagaggatgtcgaattcatcaacacaatttttgatcgttgttccaaggatttgaaaaaggtatacatgtaacgggacataacacatcctagtgatataatgtatattgtaaaatgacaacggacattgaaaaatggataatgagaacctacttctcttgaaaatgtaaaggatagatgagctttaccgttgtagcgaacagcaaaagaaacctgttagagtactggcaatcaaacaaacacgagataagaccacgaatcacggcgacacggctgtataaagaactccaataagcacacagagagttcctagatagatgtataaggttcgcaccttacgaatttgctaagggagttcaaggattgtggacgcgattttacaagaaagttgcgtccaaaatttgagaacaggtactactttgatcgaatagagtttagtactgagtgctgttgatgaaaagaccagcgaccgttgcatatgactgcgatagagagaaaccgagcaacccgctttcgctctctaaattttggtacaggaaagatccgtccaaaatttgagaaattcgcaattcgataatatccgatgccatcatcgtcaagagagacttaattgtctcttttttattaccttcattcccctgcggggggatgaaatagtcctcaacaaatcccgtcaagcttttaaagtacattatcattttcagaaggaactagtttacgaagtaaacgtagtgacttcttgagttacgagagaacgaagtgaatgagtaacacaacgaaaatatccaatacatctgaattaacacaaatgttattcaaagaatattttgagtatcaaatcaaaagcgatcataatttggttcagacctatttgaagagaatcaaagatccattaagtttaaacaaaggaactgaattttataacagtattttagactttattaatttagttcatacaaacagacctattgtagttttcttctttgataaatcaattcctgtagaagttcctgataatgtattttttgttactgaaactgatttaagtaatcaaagtactgtaagtagattaaggaattgcttacttataatttgtgattcttcattatataacaatagagtactatggaatagaagtaagagaaatgcagtttcagaaatgaatcctgaagttacctttattattaactaaataccatagaataactctaaggagagatttatggaaaatattaatgatttgcgacatgtaatggactttattggagatactgaagaagatagttcttatgatgaagtactacttacatttattgagaatagtttatttttaagtgctgctgctcacaactggcatttacagagccatttctacactaagcacctacaattggatgaactatacaaagagttacctgagtacgttgatgcatttgtagagggtattatgaacactcgcggtgcattgcaggtaggtactggtaacagttatcgttttacccctatcgaggattgtgtaccaattcttgaagaatatgttagtcaatgtaaagccattcatgctatgcttgaagaggctgaagactatggcagtactaacacactagaagacattatgagtttttgtgaaggaatgctttacaaactcaaagttttacaataaaatatatggagagtcattgtgactctccttttcttttggagaatatatatgagtgattaccgcgtaacatctggactaatggcccgtcttattgaagcagttcctgaagatgattatgaagctatttcagatcgtctttttgacgcagattctaaactccatattacatatgatggtgcattgatttacagtactgatattgatatgtctagttatgaatttgagatttcttttggtaacaaactaactactgaagaattcgctcaaaaatgtgagcgtgaagggttgtgtattgatattagttcagttcagccatatacatcactgtggtatgatggtgctgatagtccaatgtctactacatctttacaggattttctaaatgcaaatcaaaaagattaaattccaccagcattgttctatacatgaatgtgatgattgtggtatgaacatgagtgacatttatacagtttcctgtaaaggattcaaattcactcacggtgaacctgcatattgttatggcacagaagaaggtgatatcgaagtagtactgaaagaattgttccagtacttgcaaagtgcaggtcatgatgttacaatgcccacatattacgaagatgattatgactcacatgtagaagaaaatacatattataatcaattcgttcatggtaatggttttatcacatacctacatgagaatggtattgaggtaaaaactaagtacactagtgatgattacgaaagcgatgactctatggagattgaagattgaaagcaaaagacctagcagcactgttgatgcagaaccctgaaatggaagtgtatcatgagcacatgcatattgatgatatgtgtgaatcgtactattcaccagaaaatgtgtctgggattgaaattacaccaagtggtgtattcatcagtactgaacgtatggattacaattcccagcaagaaatcaaaactccacataataaacctcgcattggtgctattgacctagtatttcatcaggaccgtttggttgaatatgatgaagacgatggtactacccgaactgatgttgagaatgttgtttttcctttttataatgcatacgaagacccaacaactggggaagacttatttcgtgagctattagaggatggacaagtttatggtcagaatggaacagttttcacactagaccctaattatgaaccagatcataacacatggcaattctacacacctgaagatgtaatggaagttaaagtacttacagatcttgacgataattggaacccagtatatacttcaatgacatttgaagaagcaaaaaaccatttcgtttctaaactaaacattacaaaagaataaggatttgaaatttatgaaaattgtcgcaagtgcatggatgaaacttactgatggtactactgcttttgaagagtatggttttgttgaaagtgtagaagaattaaagcgtttcaaaagtgaaaatgatgatgatgtatttgacattgtattcacctatcaccatattccaaatgatacagattatgaacattattattacaatccagatctgttggaaaatctagtgtgcgacaatcaacatgaaattgatgaaaacactgctctactaatgctgagtaccgtatctccggtataaggagttatatgtataaccttacaattatccgcgaaccaaatgaatatgacggtaatacaacctatggtgaagttttggtatttcaaagtactgaacaaagtggtattgaacataaattaaaagattatttacgtgatcatttatatctgcaccgtactgatgcaaattgtaattatggtgatataatgtttattgtaacgcacaatggtgcggtaattgaacatatgaacatgacaaatgtaatggatttttataattacactgatacttcttttccattggataactatttcagtactgtttttgatgcgttacgtaagaacgttgctaaaaatgatagattctgtactaattttagattattagaaacaaatacaagaaagaatctttctaagaagtatgatgaagaacataagaaaaatcaggaaattcaacgtttacatgagttaatgaagaaatatcccaacgaggtcaaatatggctcttagaggacaaactcaatataagtgtattgaagaaatcagaaagaaagatggaacactttttgacaggaaattaaaacaagaatataaagacctaagagatgttatccgaaatgaaagtttcggtgggaagcgtagacagaagatttatgaatttctgaagaatggtgtagaaattcaagtcaatggtcttcattgtgtacaaaccaaaaacgatccagatattttacgtcttttaaaagagggtaaaatagaaatgttcaatatcccaatttcatcctatggtaatagattaaaatgtaagcacacgtacttaaggattaaaaatgggtaaattagtatattactatggtagtatgtctagtggtaaaagtactcatcttttacaaaaagcatataaccataagaaaaatggaatgaaggtaatttacttaaccagtgcacttgatgatcgttatggaacaggaaagattacttcgagaattggcatcgaagctgaggctgaagtaattccaaaaaatgacattagtgttcttcttaaagttaaagaaacactcaaaaatgacgttgacattaacagtatctatgttgatgaatgtcaatttttaaacagagaacaaattgaccatttagctgatatagcagataattatggtgttgatgtttcctgttatggaatccgaacagattttgaatccaatctttttgaaggttcacaaagactgttcgagatagctgatgacatacatgaacttaagaacgtgtgtgagaatcagaagtgtggcaaagaagccactatgaatgcccgtatagttgaaagtactgataaagtctttattggtggtgatgaatcatacaagagtctatgcagaacttgctatatggattatatgaggaataaaaatggttgattcatttatgaaacgcgttttgaatgatgtactatctggatttaaaaaagcgactagtcttatttttagttcagtagtgatggttattaccgtaatggcatttgcacttgtactgcattttgtaccattctggttagtcttcattgtactcattgttcttctaggtacacatgtttattatgtttaccgtgaaatattggatgatgataacgtttaaaagtgtttgacctcactatgtggggtctttttaaggtatctatatgcataacgaaactgaagtcttcaaacgtttcattgatatttgtttacacacgaatttggtatatttgggtccaggagcaaacttcagaactttatcttcaattttaggatacactgaaccatcatgcttatattgcgatgggaacatgatccatctcactgatggtgattttaatgttcagtacatttcacaatgtgatatgtatgtgtttaatacaccagaatataatattattattgaagaacgtactaaagataattacccaacccaatatgtaagttgggatagaacagattgcgtatatgccactggtccagtacagaaacctatgaactatcctactattcatttgaatgttattcatgatgaattgaaagattattgtaagagtatttcagattcggaaacaaaatactttcctattatattttttaaggtttgattatgagatggcgtaaacgacacgtaaaaagatttaataaaataatcaaaaagtatttctcgcataagttagatccaatcacacttcaactaagaagtagtatgtttgatagacgtttcccacagtgtttagaatcgtacagtcgtaaacgttccaagaatgaatacctggtatatcgttatgatttatcagaattctttttgaatactcgtgtatctgtacccatcagactgtactcaagggtaaaacgcagtagggttcaagatatcacttatggttatcttatgcttgagattaatgaactcaatgaaaaaacaggtagaaatttcagtactttatgtctggaaaacaatgataccataaaaagaattatagaagatttgggcaagtaggattttttatgctataattggagatgagtatgaaatacatcgacaaaggtacagttgaaacacagtactggaatattcatattgctggtgatatccaaacagcaagagagtacacaagaaagtttgcattcaaacttggattttgtgtacaattgattccgtgtgaatacatctacacgggtggtcttgaaagtggaatgtgtgctcgtattattcagtacccacgctttccaaaagaagaagtatatctcaaccgagatgtattaaactatgctaagggtttagctgaagagttgtgtcaaaagagttttactattgagcgaaacaatgatacaatctattatgaaagtgccgaccctttacacaagaaatgaaaggaaaatatatgaatggactaaaaaagtttggtaaagattttctaaagtgcatccgttatacatacgatgctaaccctgaaatgaccgccattgtgggtgtgtttattacactcgttgtattaagctttattgtggtgtaaaatatgattgaaattaatgctgatgtttattgtagtgcatcaccaaactacttcatttatgcactaagtacatttggtgaaactgaaggtgaaacttttgttttagtagataatactacatggtacaaaacaagtaataaaattccgaaagatgttttagaaacttatgttcgtattgaaaataaaaacatatatgtaaatttataggtaaaatatgattgaaatggaaggaactctggtgtatgatccagatcgtggcactatgaaaaagaagaaggacttctggttagtactgcaacttccattacagttggttcgatactaccagtacttcatcagaactgacttacatattgatattaaagacccacaatggggagcacatgtcagtatcgttcgtggtgaagtgccaccaaatccagagtactggaaaaagtacgatggtatgaaagttaagattaagttcgaacctttcatcgaagaagtaaaagacaataagaaacctgggtcattctttatcatagagtttgaagatgatttcattgcacaaattcgtgatgaacttggtttagcatctaaatatttcaaatatcacatcaccattggtagaacatactacgattaatgtggttatttggtaaataggtcttgatataactaaaaagtatgctatactacttaaatgttccaaagaacaactgagtactgtagaaagtccaatgaggcttttgcaaatggcctctttgccctctttgtgattgctcattgttaacaaccaacaaaggaggcgttttgaaaaaagcgaaaaaagcactgaaaactaaaattgccgtaggcgtattagtttcatcagccctattcgctgctattggattttatggtttttctcaaagtgatcatgtaccatcattagacgaaagtcaggtgcataatttaaaaccacagtttactcaaattcaaaagcaggaactaccaaaggtatcagtaccaaaagcagttccaagcagcgagaaacattatacggttcaacctggtgatagttattattctattgcacagaaatttaaacctaaaaatgtacagattgaagattatgtcattttgttgaagaacatcaacttaaatgcaactcttcatacttctcagggtatctttatcccaacaaaagaggatttgaagcacgtattgttaccagatgtgactgtactgtttgattataaagatccagaaattgtcaatcacatcaaagaagctgaaggttctattgaatttcagtccaagaacaaacgacgtttacttggtgggaaagttggagttccatatcgaaattctaaattttatccgtatcgtgatataaaaggtaacttcactattgggtacggacattatcttggaaagaaagaatcagatgcaagtaagtatcgtaatggtattacgaagtcacaagcacataaacttttattgtctgacatggaacgaactaataatgatttagttttattattgaagaaaagaaatgcaacaaaccttacggctgaacaacaacgaattttatttgagatggcatttacattaggagttgataagttaaatactttcaataaattatggaaaagcgttgataatcaaaatgataacaagttcaaaaaagaaattaagaattctctatggtatcgtcaagtaggaaaccgtgcagaattgttagttagtaatctttaaaactaaaaaaaaggtaggtaaattatgctagatttagttatccaaggtaatgttgatattactccagcaatcaatgacgcgattcatgcagaagcaaatgcactaacgaagtttagtgattcttcagtactttatatcggtgttcatgtgaagaaagagcataagaatcaatattccgtaactttaacatcaggtggtaagattgtcaccgccgatgatgcagatttatacaaagcaattggtgattcatttgaaaaaatggaaactgtcttaggtaaagacaaaagcatcaaattgcatcgccgtaaccaccccgaacatccagttcaagaagacttgactgaagacgaagagtaagatataataaagggacagagattattctgtcccttttctttttggagtacattatgaatgcagtactgatatttttaatgtgtgttgtatttggtgcttttggactattcgtaattttagatactgaaccaagtactgaagtaggtacaaccatcacacttaaacctggtgttaaaattaatgatacctattgctacaatccaaacacaaaccgttatgagatttgtttatgaaaacattcaacattgttcatataattgaaccgattgcagaacatattaaaaacataagtaagaacgagtcaggttttttcttcaatttagacaaacttcatcgctataccaatgtatctagttttaatcgtgctaagagactttatatccgtatacacaacctatggtacagtgacgatacgttgatgatagatattactgttgatgaagacataacattaagatacattgacgattttaaatcagatgatattcgtgctggatcattaccaattgatgcttcatatgaagaatatctacaataccagttcattgatgacacatttggatttgactttgaactatataatagtataatgaacgtataccatatatacgaaaggaatttgaatggacattcgtaaaataccaaatttccacaatacattaaggttcttttctgaacaagaaatcagtactgaaatacgaggcatgatttcgtataatcaatatagagtactaaccactaataaatttcagggtacagtacgtgtaaaaatacgaaacgcgttagtagagaatgatgaattattaattacacttagaaaaagtaagatagaattaacatacgcaattttcgatactacatgtgatttgatgtggaacacactgttaaaaaaagaaggttcattgccagtttatgataatggtcctgaaacacttgatcagtacatgttcattgatgatacatttggcattgactattctgcatatcagtgtatactagctatacataaaaaatattacgaccgtctacgtgacagattaatttaattggaggcattatgattgctatgttagaagaagattggggtgtttccgagcaaggtactgatgaatatgaatacccagaataccaaccaaaaggcttctgggaacgtctacgtgattggttgatgggggaatgatatgaaaaagtatttggttggtggctacgttcgtgaccgtttaatgggcatccgtgcaaaagacaaagattatgttattgtcggtgctaccgaatccgatattaaatacttgcaaagtattggatacaagcaagtaggtaaggatttccctgtatatctaagcccagaaggtaatgaacacgcattagcccgtactgagcgtaaaactggtactggatatggtggcttcgaagtgaatacaaaaggtgtgacactagaacaagatctatatcgtcgtgatctcacaatcaatagtattgcatatgacccagtactccagattcacatcgacccttatggcgggaaagctgatatcaaaaacaaagtacttcgtcatgtatcagaacactttaaagaagatccattgcgtgttctacgtttggcccgtttcgctacacgttactctgactttacaatccatgatgatactatgacaatgtgtaaagatatggttagtactggtgaactagaccatctagttccagaacgtgtttttgttgaattcgaaaaagcactttctgaagaaaacccttccaagtttatcaaaactctggtacaatttggttattacgaaaaggcatttactacagttccagttaccaagaaacgtctggaattaattgatgctatcgctgcaaattgtacagaagaatataaaccatatttcttatggacagtacttcttgaaaatgaagaagtaaataatgattcagtacttaacggttccattaaggttccagttaagtacgtgaagtttagtaattacatcaagcgtttccgtgaagatattaaaaccttccgtaagaagaccccagttgaaatgggacaaatcttactggatatgaatatcaaaaacaatggtggtgaagatttcctttacaaagtactggaaaacttcattttgaacaaagaaattgattctgatcttgaagatttgattattaaagtttatgatcgttatactgatgttgaattacctgatattcagcagttagtgaaagatggtgaactccaaacatcagagattcgtgattttgttgctgaattgcgtattgaagcaatcaagcaaatgttctaaaagctgggacaagttaacatcttctgatataattactagtatctgaacatcacttgatgataaagagataagattatgcgttatagctgtggtataatattttatcgtgatggtcagatacttatcgggcatacaacacggacagaatcactgggacttacctaaaggtaaaactgaaggtacagaaacatttaaagaggctgctgtacgtgaatgctacgaagagacaggatatgaaatcgatgaagatgatcttctgtttcttggtgatgtatcgtatagaaaggggaaacgtttagttttatttttctatacagccaaagataagcctataccagaagagttggtgtgcaaaagtacttacacaaaccgatatggtagaagtcacccagaattggataagttcatgtacattgatgtactagattgtcaaaagtatttgactgaacgaatgtgtaacagtataataaaggctgttacgatgtttcaacgaaataaagggaaaagaaatgaaagttaaaatttatggtcgcactactggttgtaaattctgcgacactgctaaagcagtatgtgaaaataacaaatttgatatggagtttatcgatattgttaccgctggtattgatggtgctaaactatctgaactatgtggtgagccagtacgacaggttccacaaattttcgtaaacgatgtttacgttccaggtggctgtactggtttcgttgaaggtcttaaagaaggtcgctggaattaatgaatattgataaagtatcatctcgtgcaaaacatttagctgacacattgggtgttgaatttaaaatgcctgatatggaagctgcaaaagttaaagcacaacgtaaaattcacaaaatgaaagaatacactactaagaaagaacagtacgataaagcggttgcttatattattgaagctttcagtaaagatgatattttggcattcatcgcttcagtagaggtttcgagcaaccctaaataataatgaagaacacaagttcttcgtaacaatttgggagatactattatgctcagttttcgtgaacaattagcaaaaggccaattcgctgctaaagctcaaacatccattcctaaaaagtctgctttcttagggacgattacagaagatggttattgtgattatgatgcaccagaagattcatggtacattacgaaagacacaaaacgtggtaatagacttcacaaaagtaccattgctcgcaaacaacgaaaagaattgaaaaaaattcgattcggtgaagaagaataaaatataaattaaggactctgattacagagtcctttcttttcggagaatataatgatacatgaacattgtggtaatctgtttgatttattcagtactgttactactgatcaaactgcattacatattatcgctcatggttgtaacgctcagggtaagatgggttctggttttgcaaaagaattaagaaagcgtcaccaattggcatatgatgtgtatcatacacgttataccaatcagaatggtttgaaattgggtgaagttgtctatgcagcaccaaataataacttaattattgcaaactgcattacacaagagtattatggtaatgatggtaagaagtatgtaagttatgatgcgattgaccttgcatttaactcgatgaatgaattcattaaaaatgaaccacaagagatccatgtacacttcccgaaaattggagccgatttaggcggtggtaactggaacgttatcaaagaaatcattgaccacagactggttaatgcagaaaaacacttatacattctaaaataaacaaaaggacttgacaaaaatgactatgaccgttaaactactaaacatcaacagcgttggcctagtactagcaattctacaaaatgatgcaccagaagcagtagtagttaactacccagcacagctaggtactgacgaacaaggtgaaatcattctacgtgattacctagaattcattagttctgaaaaaggcgttattttttataaatccaacatcattagcatcagcgatgcaaaccctgcactagttgaagcttatgttgaagcaatcaaggctatcgaagaaaaaccagcactgattgttcctgataacaaaatcattctataatagaggtatctaatggctgctcaaaacgttaaagttaaaactatccaagctatcgtagtactgaaagattctactccatcaccaaaagaactggttatggctggtatgacaatgctacatcagtacaatccagaatcacctaactatgtactggaatacgaagcgaagcagtttaaagaacattggcagtcatggattaaagataatgaaatggaacaggttgtttatgctgctgatgacattttcgaattagaacaaatcgaatatctagcaggacaacaatctgtaccattgagtatcttcggtaatggagaagaagttttagtactgggaccatttaccgctgatgccatcatgcatttactaagtaattgtaaaaaagttggctaaaaaacaaatattatcaggttaccgtaataacacgttgcactacaatgacttaaagtactgggttgacccacacaacaataagtcattgttgctgtacagagataaatttcgagatttgtacggtatatatgacacacagttaatatacttagttgataccgaacattttgctcctatggtatacttgtattgcttgtataattccaaataactattagcacctctaaataatgtatataaacattaatgaggtgcttttttatgtcttacgattatatgggtggaaacccagatgctccaaactttgatcatcgtgaaaaactgaaagatgttatcactcaaatgttaggtgctggtgcagttgaagttgaaattactgatggtcaattggaaattgcaattgataatgcggtatcaaactaccgagcatggagttctgcttcaaaagaagaagcattcttgaacatgaaattctatgattcacaatctgtatacatgcttcctactgaagttgaaattgtcaaacagatttatcgttatggtaacggttatctaagttctggtagtggtaactcagtagaccctttttcactcgcatttaccaacacttaccttttaacgtctgcacgtaacgctggtggttatgacttaactacttatgattttagttttcaattccaagaattagttgggcgtatgtttggtagagaaatcatcttccagttcaacccaatgaccaaaaaactaataattgatcgtgatattcgcggtactgaagaagtgctattacatgtatatcataatatacctgaaccattgctattccaacgtcaacaaagctatccttggctacgtgactgggcattgtctgaagctatgattatgttgggtcgcaaccgtgctaaatttgctacattgcctggaccacagggtacattctctatggatggtgatacattacgtaatgaaggtgcacaacttcaagaacagcttaaagaacagttgaagagatacaaagatggtggtgacccacttggaatgattatcggataaaacaaaaaaaaagactcctatatggggtctttttttatatgttgtgatataatgataatattaatctaaaggaacctgacatgaataacaacatagatgcagtgtatgcaatgtataacaaatatacttgtggagcacctacattggattatgaatcaaccgaaaagaactggaaatttataaaagaatcaatcgtagatgttttcggtagagatcgaataaacgcgtgggcgagtatatgtcgtgatgataatggagaaacattctacatcacttatgttactatatattatgggagtgagtttatagttggattacttgaatgtttagtaggaaaggatttagtagtacttatataatatacatggagaagtattatggaaagacaaataattgcaattaacggtactatcggtagcggcaaagatacttttggtgaaacttttatcaataatggttacaccagaatgtcatttgcaactaatcttaaagattcagttgctgctatctttggatgggatcgtgaaatgcttgagggttcgactaaggaaagtcgtaaactccgtgaagagccagaccagtactggtgcgagaagttgggtcgtaacgatgtttcccctcgttgggtattacagaattacggaactaatattttgcgtaagtactttcataatgatatttgggtacatagtttagagaagtcaatgcaatcggttgaagggaatattatcatcactgactgtcgatttccaaatgaactaaaaatggttcgttcactaaatggtatcgtgattgaagttcagcgtactctcccacactggtatggtttagcagcatcttttaataaaggtgatattagtatgaagccaattgagttagaatcagtacatgaatctgaatgggcgtggattggtatcaataatcctgatatcattgtacaaaataatagcacaattgaagcgttgcaccaacaagcattgagcgttatttatgccaataagtgaaattaaaacaattaggacttgacattcaaatccttcaataaataagactatacgaatataattcgaataaccaattatttttggaggatttaatatggcaggagatctactctcacctggcgtttccatttcagtaactgatgaaagtatgagtactgctgctgctcctggcacagtaccactatttgtaatcgctactgctgaagacaaacttgttcctggtagcagtgcaatcgctgcgggaaccactaaagcaaacgctggtaaactacagctactaacatcacagaaaagctcactagatacatttggctcaccaattttccaaatgaacaatggttcagttgttcaaggtgacgaactaaacgaatatggtctacatgctgtatattcttatctaggcatcaccaaccgtgcatatgttattcgtgctgatatcgatttggctcaactatcaccaagtgcaactgcaccaactggcccagtaccaaatggtactctatggtttgatgctgctcaatcacaaattgaagcttatgttgctaagaaagacagcccaagcagcttctatgactggcaattgaagcctgttaccatcgtaagttctgaagaagttgacgatgttagcctagttggtctaaacgttgatgatctagttctacgttataagccaagtaatggtcaaatgcttatgtacaaacgtgcagcatctggtctagtacaggttgaaacttatctatcaccaatcaacaaagttccagttggttcaactgttgaacaaggtaacgtatggattcgtgatggttatactcaaaatggttcaaactattttggtactcgctttgttctaaaacgttatgcatctctaactcaagtttggaatatcgttccagcatatactggtaattctttccaagaagttgaagctaagagtggtgtactaaacaacagttatattgcttgccgttttgatgacgatagtaagagtttctctttctatattcaaagtgcaaaactatcagcaattagtgctccagcagtaccactaggtgaaactgttattgagcaagctggtgaagatagttatttgactttcgcttacctaaacaaatctgttaaagtacttgcagtaccacaaggtggcgtaattaatactcaaactatcatcgataatctaaatgttagtgctgatcttatcaatgatggattcaaattcaaacgtgaatctaatggtggtttggtagttacaaacaccaaaggttatagctttaaagttacccaaagcggtgatgatatttttgcagcgaatgaactagctaaactaactgtagatagtaataactattctctagttaacgttaataacttacgtgttagctcttctgttccacgtagcattgctaaagatggtactatttggtatgatttcagtaattccgataacctaactgttaccatgtacattgcagatgttgcaaatgacgaatgggatctagtacaagaagataacaaatacgttcaagttgatgagccagcggctgaccgtctaatttgggtacgccctctatctcaaggcattgatggttatgatttctatcgtaacgttgatggtgagtgggttaaactagacaatactgaccaaagtactctaaacggtatgatttttgctgactttaacttccctgaacaagttgcggcggctgctctttatcagaatggtatgcttgcaattgacctcggtaataccgaaggtgttgttaagaaaatggttaatggtcaatggcaagttgttagtggtgttagtcttgatggtgcaggtctatttggtcgtgcagcacaacgccaactaatcgttgaagcactagctgctgtaatcatcggtaatgatgatatccgttctgaattcatcgactttaacctaatctgtgttcctggttatgtagaaactctagatgaatgtattaccctaaacactgatcgtaaagaaacagcgtttatcgtaactgatgtacctgctcgtttgaacccaaccggaaacggtagtgcagttcaagaatgggctaccaacgcgaacaacgcaccaagtaatggttcagtaggccgtacttctgcatatgattatgctgctcagtacatgggctggtgtttaagtactaacgttgatggtgaagaagttgcagtcccaggcagtactgttgcaatgcgtacctatgcgtacagtgatagtgttagttttgtatggtatccacctgctggtactactcgtggtgttgtaaccaacgctgcaagtactggtttcattaatagtgaaggtgaatatcaaccagtagtatacaaccaaggtcaacgtgacgtgatgtatacaaacaacattaacccaattgcaatgcgtcctaaccgtggcttgctagtatatggtgataaaacactatctgctaaccaaacctctgcactaagccgtgttaacgttgctcgtttggttgtttacattcgtcgtcaactagaaatcatctctgaaccattcctattccgtttgaatactccaagtactcgtcaggaattcagtggtgtagtgaatagcttcctagctgaaatcgttcaacaacaaggtctatataacttcgcagtagtttgtgacgaaagtaacaacacttctgaacgtattgatcgtaacgaactttggatggatattgcaatccaacctactaagtctatcaacttcatttacgtaccgattcgtattgaaaagactcaataaaatactaagggaaccttttggttcccttttttattgtttaaaattaaatacgttatattattaattaaacgattaggaataatatggaagaaatacttaaaaaaacattacaagatgtaagtaaaactgtagcaacacaggacgatgccgtaaaaatccttaaagcttttatacaaaatttggaacattgtcggtataattcgagaatacaatgtttacacaaatggtaaatggtcggttggtgtaaactatacagatcataaacaagaaaaaaagtacttgtattgtgtgaatatagattggttccctgttgatgagatacttcaataaaagtgtaagtaatagataaataatataaagatgtcattccataacaggagaatataaatggctacaatgcttgatcgatatggcgttccgctcgctggcggtggtcgtatctctatgaaacaacctaaagcaaaatataaattccgtgttgttttctttggcttcggtgctaacgacgatggcaatatgattaccctagataccaacaccgttggtgctgtatctgtatcacatgaaaacgtcactgtgcatagttataacagttctgctcactataaaggtaagtatacttgggatactattgatgtggctttccgtgattccgtaggtaatgcttctgctaaagctctttataaccaaatgcgtaaagaatttaactattacagtcaagaatctcgtatgactgattcccagttcaaatttgaaatgtggattcaagaactagatggttctaatagtgaaaacacttctaacctttttgaaggtactttgagtacttgggtatgtcaaggctgctttattgaatctagtaactttggtgactgggattattcctcaagtgaagcacaagttatttctatgacaattcaaccagacggctgtgcaaaactcggtcctaatggtgaagcgttcggtgatgaaattactggtttcggtaacccatccactgctacctctattagtggtgcacaaaccaacattagtagtactactctaccagatagtaacttctacgaaaattaatttttcttttaaacgtaagcctcgaactagttcggggctttttttatgctaaataaagtataataccttataaaataaaagaggttgctatggcaaataacatgattaataaatatggcgttcctctaccatcaggacgtaaccgttcaatgttacaaccgaaagcaaaatacaaatttcgtgttattgtatataatttcggtactgatatagatgagcgtgatcacattgcattagatgttgataaagttgatagacctactgttactttcagtactcataaactatatcaatttacaacaaatacatcttacattggtagtcacgattgggacccaattactttaactatccgtgattcagttggtaatgcatcagcaaaagccttgtcacgacaattacagaaacaattagattttcaacgaagaattacttccagaactgaccatgattatggttcatataagttcggaattgtcattcagatgttgaatggtcgcaactctgatgatacactagaagacttgggaagaaacacattagttaatgcaacaactgccgctaccaacaatactggattagtcaacgctgttgatcagttcattggtggatcatcatacaatagtgctggcgttatggagtactttgtactaacaggatgtgttatacaaaatatatcatatgattcacttgactatagttcaagttctcctgttgaaatggttattacaataaaacctgataattgtatccaattcgataatatcgaagaaatgtacagtactagaataaattcacttttacctgaaaacgtaaaccaaggattagatatcattgaccgtgttttcggtagcattggattataaggagataacccatgagtgatttttttgattcatttgtcagtactggaactagtatagttaatggtgttattgacaatatcaacatcattagagatccagcttttgagaattataacgcggcacaacgagtgtttggtacagcaggtgaaatgggtttttcattctataatttaccaaaatttaagaacagttttattatcgaatttgtactaaccccgttcgcaaagaactttattaaaacacaactcccagatacacatactgattttgatgttaataatgtatcgtgctttgtaaaagatgtaacacttcctagtttttcttttagtgttgaaaccgtaaaccaatacaacaaaaaacgtttagttacgggtgatattgtttataaaccaagtaatgttgttttctatgatactgtcgatggtgctggatatcttttaatggacgcatatcgtaagttctactatggtgacttctttgataagaatccacaatcttatcgaaatgacgtactcagtacaccagaaaatttcaatggtttaggtggaaactggggtcgttctgtaatgaataatggtaactacgacaaccagtactttttcaaatcaattaatatctatgaaattgataatgaaacctatacagttcataacatgataaatgtattcattgaagatatacaattagaaactaaatctatggaaagtgaaggtgacccatcactattatcgttgactatgcgttatgaagcgtgtaacaactttggccccgaagggtacttgagtattggtgttcctactatggaaattgcacaacttatcaccgatactgaaggtcttggtgtgagtggattcttcaaatactttggtgaacttgatgataagaccaaaggaattacgacggttggtaaaattatccgagcaggaacctcagttagtgatataatcagtagtgctggtgatatccttcgtggtgacattactcctgataccatccgaaacataggttccgcagtgacaagaggtgcaaatgctattggtttaggtagcatcatttcctcagcaagctcgaaattcggattaggtaatatattaggagatttttaaatggcatttaaccagcagtttaacccagcgaagattaccaactccaaacaggctcaaggtatcttccctataaaaaatatacaaaagtataaaagtaataaccaacctatataccgtagttcttgggaaaaggatatcatgatatctttagacaacaaccctgcggttatagagtggagtgtagagccatttagtattccttacgtgaatccagttgataatgcagttcatcagtactggcctgatttttatgtactttatattggtgcagatggtaagcaacatgctcaagtactggaagttaaaccgtacaaacaatgtcacatggaaatggctaaatccaagaaagacaaaatcaccgttgcgattaaccaatcaaaatgggcatatgcaatggaattttgtaaaaataaccggattggaatttaaaatcattacagaaaggaatctatataaaaaatgaaacctaaacaacaagtagatgaagcactgggattacctagtgctaaacaatggatggaaatgacaggccaggagccagaagaagatacagagatggatttgtatcaggatgacgaagatgaacagagtgaaactgaaatttcattagaagaagcaaaagctgcaatggaaaaattgaaagctatgcgtgttcagttgcgtgaacttccagatattacagcaagaaaaactcaattagatcgtttagcacagatggcagaacgtaagtttgaagatattttcgaccgtgctttcaactgtgaagaccgttttgcagcagaaatgattaacgctgcaaactctatgttaaaaattgctctcgatgctcatgcaaaaatcattgattctgacgttaaattagtagatcttcaactcaagaaagataagatggaaatcgatctaaaccttaaaactaagaaacctgaatcagttggtgacccaacagccatcgaaggacaggcggtagcacataaaacccgcaatgaaatgcttgcagcaatgaacagaaataaataacttaaacgaccttatggagttattaaaatgaatagattacaacaaatcctaacagataaaaaaccagtttttgaataccgagtcaagtttgcagttgaacctactaacgaacaacttagtaaagtatcacaacgcctaatggatcgttatgatgcatttgatattggtgcactcaagaaaactattttcatggaaaaaccactagatttttatgaattagattgtggtgaaatttggatgtttgatttcaaatgccaccgtggtgttcaatcaaacgtactaatgtatgaaattggtaacctactaagtatgactgaagctctaatccgtgtacgtagtaaagatgaaccacgtcaacaagaaatgaccgaactcgaagatgatattgactttgacgattacgaaccagtaattggtgttgattttggtaaaccagaagacagccacgatttagctggtgaagaacgtgctgtaaccgcagttaaagatgcgattgaagcagtaaaaagtgacaataaatactctcaatatatgagtgctggttttggtaaaaaggattgagacatgagtatacttaatgaaatgttagattataatgatgaagagctaaatgaagctcgtccatatagtcgttcacaaagtgcagtagatagtgcaaaaggaaaagtaaaaggctttttcggtagtggtcaagtagaacaaggtgcacaagaagttggtgcagaagcaaaccgtctttgggctgaatttaaacgctatgttggacgcaaatacggtaaagcacagccatcagtaccatatgctgatgttgcacaattcttcaaaggaaataaccttgatataaaacatttgggcaataacagtcgtcgtacttttactcctaaagatgttggttctgctctattggcagcagcacgtgacttgatgaatgattatcgtgatgatgataaaggtgaagaacaacaacgtcctgcaccacaagctcaacctgacaatgctccacaatcagcaccacaggaacagccaaaagcacaaggttctagtatccctgatgctctacaaaaattaagtccagagcagcgtgaacaacttttgcgtatgctttcttaaggagaatcaacacatggataattttttcagtactgaaactaccacagtacctaatggatatgtatatacttctcacactggtggcaaatatgtatttcttgaaggtttctggtttaacgacaataatatgttaatggtagaccctaaaaaatacccatccatgtacgcaagtgctcgacaacagattgttgagcacaatctatcttctagtgaatataaaattggtaacaaatatattcttgaaggtaaagagtgtacatttcttggtgaaaatcgtttcaattctaaagatggaattctactaactgaaagtgaaattatcactgaactaatggcagatgaccaccgtgtatataatgtttcaaaagaaactctacaaaaagaatggaactccctaaaattctatatccttccaccatatgctgatgatatttctattccagcaggtatggaagttagtggatttaaattcatccctaaaaatcaccgttttgttgatgcaaaatctggacgtccagttgatccagcaatgacccgtaaactttccgatgaaggtatgcgtattgctcgccaattagcaccaaaaaacaaactaattccaattaaatctactttagtacaaggcaatactcgttccgaatggaatggtaaagaattttgtgataatgatggtaatgttgtaattccagaacaaaatgcacatgtaatctttaatgcatatcagcaatttgttaaggctaaccctggtgattttccttcactaactggtgaacatgaatcaggtgaacaacgttttggttcaggtgaaaagccagaacaacctaaacacccagtaaaacagccagtattcgcaacaaaagaatccattaatgaagcagatgaagagattgaagaaactgaatctgttgtggttccaaatggttaccgcattacttcaaataaaggtaaaacatacattaaacaaaaagatgcatggtttgatgtagaaactaaaaaacaactaaatgttagtgctgcaaaaagtgttgaacgtgctgctcaacgtgatataattcgccataacagttctggtgcaatgaaaatcggaactaaagtaaaatctaagaaaggcacagagtattcttatatcggtggtaaccgctttattagtgctgatggtaaattgattccaaaatcaactgctgataacattcttgctcgttatgatgcagaacgtgctgataagaaagaagaagaacctgaagagaaagtagatgctgaagtatcaagtactgatgtagttgagccaaaagctgaacctactaaagaaccagaacctgttgcagagccagaacctgaagttcctgctgctggggatgaagttcaatcattagcttcacgaattaaagaatcaccttacgctaagaaaattacagtactcttaacgcgtggtgatgaggtttctctaattgctgctgacattttactatctggtaaaaaggatgaaacagtgcaaattttaaaatcattaaataagaatgattgataactaaaaggatttatttaaaatggctaaaaaaattaatgaagcacaagttaaaatcgatatcgcaggtctagaatctgaagatctagaaacactatctcgtatgcttgcattagctggtcaagcagagcgtcaagcttctcctgttgctgctccagttccttctatggggtctatgaccccttctctaccaccaatcgctccactcgacatggattccattggtgcgggtgctgaagaagaagttggtggtacaatggatggtgcgattgatgcaccagttgaagacccattggaagtagctgctgactcactatctgctgaagctggtgattttggtggtgattctgaagaagtaagtatggatgcagagttcgaagagcctggtgttgcagatgaagaagagttttctttagatctttccggtcaacctcaactagaatcagttgaagaagaggaagaagaagaagaaatcatcgaagaagaattcgatttcagtcgtatgctatctctagctggtcttcaagacgaaccagaagatgaatattcagtagaaggtaacccagatactgaagttaaagttgaagaaaacactttcctaccagacctaaccatctctgaagatgaagaacaaggtgacagtactgattttggtccttacaacactgaagctgatgctgttcgtgacggtcaagctaaaactaatggtgtagaaggtgaccactttgttgttattaccaagggtaacaagttctactggagacgtgtcgttgatgaagatgttgacaatcgtcctgaaccagagtactatgacaatgacggtaacgagaaccgtgttcacaaatttgaacctaagtttccaggtactgctctaggtgacaacccactcaatgttaatgagagtgatgagtcagtggaaggtaacgaagaactagaagatgaaagcgatgaagaagtcgaagacattttcgaaagtctccagaagaaatatcaacaatttctaggggacaaataagatgggatataattatcgtgaattggttgaagcattagatgaaatcacttctagtgaagaatctactgaagaagaaagttttgcagttgagactccttctgatgctgttgccaccgatttacttaaagatatcaccgaatgccttatccacattgtggataaggttaaatcaggtgaagatcaaaaagaaatcgtagaaaagcttcaaaaagcgtgtgacattttatcggatgttcgatataatgatgaaagtactgaagaagttgatgaatccactgattgctgcttcggaaccaaagatatgggtccgaaaattggtaaagatggtgtccaagactataaagttaaagatgctccttcatatgcagcaagacagggtttcgtggggatgtaatttatgattcctgaaccacacaacagtactgaatttcaaaacgatgtacttttaaaagttagagaagtacatggatcagacgctgaattaacagaccgtatgcttctgatgtcaatttttgaaaatttcagaactggcggtggtttaagacttagcaagtttggatatacaatttgtaaagaaaacattctttatgaatttacaaaaatccccttgcaaagagagttcaaaagttctataatctttacatcgcttgataggatatgtacttcaccctactatgtagaagggcagtacatatacctctcggacgcaatgatagttacagagttaacattgtgtggtgatgattttagaatgttattttcgatgcacatgtagcttcgaaaataaagaaaaaaaaagatgttgacaacgccgaatgatgtgttataatgaccaccacgaagcaagttttcaaaatcacaagatgtgagattgaaaaagaaataaaaaagttgttgacaagcctgaacgatgtgatataatgaccacatcaagacggcaaagagaaatgcctttttaaatacacggatgattcatgaagtaacaaaggaactgataagttaaaaattcttttaacacagttcctttacttttgcccacggattggctataatagaaacctaaacgattttatccaacaaaaggaaaatatacatgtctactcaaaacaacgatatcctgaacgtaaaactgactcctaagaaagctaaagaagcaatggcactggctgacatgattcaagatagcctgatgatttggggtagccctggtatcggtaaatctgctatcgcacgtcaatacgctgatgagaactacccactgcgtaaagataacgtggcaaaaattgagttcatgaaacaacaaatcgaagctgatactgaaaatgctgatcaacttcgccgtgaactggcagcgtttgaagccaaactaatcgaccaagacactaactttatcgatttccgtttgtctcagattgaaccaagtgaccttcgcggtatcccagttccagagaaagtgttccttgatatggatggtaagcaactgattgaatctgaactggctagtgcacaagattacatcgctgaaacagcagttgtgtgggcagcacctaaagtactgaaactgtctccagattggaaaggtgttattctgtttgacgaaatcaactctgcaatgccgattgtacaggcagcgtcttatcagctaatcctcgaccgttgtgttggtgagatgaagctacctaagactgcactgattctcgcagcaggtaaccgtgaaactgatggcggtgtaacgttctctctagctacaccactgcgtgaccgtatgacccacatcgaaatgattccttatcatcaagattggattaacgattatgcgattggtaagcgtttgaacccagcaactgtagcgttcatcaacaacactggtgctaaacacttcaacacccttagcccacaagatccttctcactgtggtggtacttctccacgttcatgggaagcagtagcacgctacgaagatctgaagaaagttaagaacattgataaagaagtgttccgtgcgatgattgcaggtcgtgttggtgaaggcgtagcaactgaatacatcgagtatgttgataacgtagctaaactaccagataccatgtccatcctacagggtgagattaaagagattgatgcttcgcttgatatttccgcgaactacttcatcactctgaatctggtttacaaaattatcgacctctacaatgagaagcaagaacaacgtctaccagtggaagattggggtaagctgtgcaacaacttcatcaccttcctagaccataacttctctgcaactcaagcagaactggcagtactggcgattcgtaccatcacgcttcataaagtagcgattacgattaaagatgtaccagcgtttaaagacttcgttatgaagtactctgacctagtacgtaaagcacgctctcttggttaataattaaaaagagtgttgacaaggaggataccacatggtatccttcttttatcttaactaaacgaggaaatacaaatgtcagataaacgtttcagtgatgttactccggctctccagaaagaatgtcaagatcgtctgatcttagctcgcacatctttaatgctaacattcccattctttggtgtactggcttctcgtctgcgtccagttgcaaacaacacatggtgtcgtactttggctgtagatggtaagcatttattctacaacgtagaattcatcatgggtattcaggaccaatccaaaaagtcagcatacgaagaagcaattcgtgagaaacatcctgaagtaactgaagaacaacttaaagaaatgacagaaggtttgactgatgaaaacctgattgcagttatttgtcatgaaattcttcactgtgcatatgaccacttcttgcgtcgtggtatgcgtgacccgcagcgttataaccgtgctgctgactatgcaattaaccagattcttgttcgtgataaaattggtaaaatccaaagccaatggctgtacgataaaaagtacgatggtatgactgctgaagagatttataacattctcgaagaagaagataaacaggatcaagacggggaaggtgaaggaaatccacaggctggtagtggtgagggtgaaggtaaatcacgcggtacttttggtgatatcaaagatggtaaaggcaaaggtacaacaatcgaccagcatgacgttccacaagaaggtcaagaaggtggttcaagtgataaacaaaaacgtgattatatggatgatttcaaaacagcaatgatgaatgctgctcgtgcaggtggtactcctgctgaaatcgcacgtatgattaacaacttcaaagaacctaagattgactggcgttccaaacttcaccgcacactgcgtagctggttgaagtctgatgcaacttatcaaaatcctaatcgtcgttcatggggtgctggttttggtagttctggttcattctacgggaatccaatcttccctggtatgaaaccagatgatgatattgatattgcaattgcactagatgcatccggttctatctctgaagatatgctccgtgatttcatcagtgaagtactgggtatcactaagcagtttaaacaatttaaaatccgtatcatgacgttcgatactgaagtttatactgtgaaagattacaaaactggtgaagagagtaagattctcgaatatccagtgaaaggtggtggtggtactgactttgaagcagtatgggttcatatgaagcatgacaactataagcctaaacagcttattatgtttaccgatggtgagccgtggcagtcatggggtgatcctgattactgtaagacactgtttgttatccacagcaatcctaacaaacaagcaccatttggcgaaactgtacactacgaatatgaagctgacaaaaagcgtcaacgtagctaagtactaaataatgagaacggaattttccgttctctacttttccagcgggacagcttggaaaaaggtgatataattatatttgtaacaacatacatggagagtattaaaatggaacaagaaccagaaaaaattcaactaaccctaatcgacctaatcaacgctgctaaaatcatggaagctgctgtggctcgtaattcatttaaagtcgaagagcttgttgatgttgctcctgtcgtatctaagtttgttgagtttgctaactctgcactcgaagatatcaaagcacaagaagaagctgaagctgcacaagctgctgctgaacaaaataaaggagaataataatggctattcgtcacgttggtgtagtacgtaatacaggttcacgcgtatttgtggtatggcgttcactccctgatgatccagatcattgtctcattgtttatcgcgattcactgcctgaagcatatgctcaatctgttgcagatttagtaatgaatcaaggtcaatcaaatgtagatttgtgggaagttatgcataagattggtcatctagacggtcgcaaaatgctagatgtgcttcataatctacaacatttgcgtcgtgcacgtacttgtgatattgatatgcatgttggtggcaacaataagatttctcttgatgttctaaacaacgcaatcaatgataatgatgctaaaacacatgaagatggtaaagttaaagaatacaacccattcaagccacaagaagctgatacttctgttgaagaagctaccattgttgagcaactacttaaagatgcacaacgttatgagcagttggctaaagagcactttgaacgtgcttacaacttagaaccatctctacgtccacaagttcaagcaacacctgtagcacctgatagcaaaactttctatattgaaatcccagaaggaatttcacaaactaaagcaattgagaaagttaaacaggcatttgcagaacgtaaagcaaaataatataaatgaataaaatagaattagatgaagcaatcaatggtttatctaatgtatgtttcagtggcggggcagcaggtgctgaccgccttttttctatctatgcaaaagacaatggatttgaagtaataaatttttcattcaagggtcaccaaagcagcgtagatgaaaatactatattagaaattccacccaatatcctttgtgatagttcaatattaaaacaattaaacattgcatgttactctttacgccgtaaagttcctaagcctggttcgtatgtatataacttacttgcaaggaatagttaccaaatacttaatacaaaaagagtatattgtattgcaaatattacatcacctacgcaagtttcaggtggaactgcatgggccgtacagatgtatatggattcagttgacaatccagaaatatattgttatgatatgaacactcgctctgtattttattatgatacagtactgaaagagtttactgaaacattctcaataccagcaccacacggtaactggactgggattggttcacgtaatgctacacaaaaacacatggaacactttattacatttttcaaggacgtaaaatgaaacaactacaagaactatatcaaagaattctggatcaaggtgtcgaaagcgttgatcgtactggtgttggcactatcaagctaatcggacaacaaatgcgttttgacctaaaagaaggtttcccagcagtgactactaaacgtttggcttggaaagcaatgacttcagaattgttatggtttattgaaggttctcacgatgagcgtcgtctgtgtgaaattttacacgggacacgtgatgtagaaaagaaaacaatttggacagacaactaccttaatcaaggtgtaagccttgggtattctgatggtgagcttggcccagtttatggtaaacaatggcgtgaatgggaagattataaattcagttccagtactgaagaaattcaagaactaaaagataaagggtataaagttattgattatactggttcacatggtgttattatgcgtcgtgtaactgaccagctaaaacaagttattgaaggtatcaatactgatccatacggtcgtcgtcacattctaagtgcatggaacgttggtgagcttgatgctatgactttgccaccctgtcatagctttgtgcagttttgtgttgtacagggtaaactaagttgtattcttcatcaacgtagtgctgatctattccttggtgtaccatttaatattagtagttactcactactaactcatatgattgcacaaattacagggttagatgttggtgaatttatttggaatggtggcgactgccatatctatcaaaaccatattgaacaagtaaaagagcaactccaacgtgaaccacgtacattaccagaattatggctagatcctactattactgatattgaagatttcactatggattctttcaaattagttaattacgatccaatgccaacaatcaaagcaccaatggctgtataaaagaaaagggagacttatgtctcccttttttattatcttaatgtaaccagtgtacgtccggcaaatctcacatcaggagttgcaggaatactgaacactacgcttgttccattgaatgtaacactatcaacttcaacacgagtgtaaacaccagtacttacgagttcttgaatttcagcagttactatgttactagcagttactgttaatgtgtaatatgagccgtttaaaacccacgctgacgcagtaaacgggtcagtacgtacagaaccagaaccaattggaacccattgtccttggaccttctgcatcgatgtacgttcggtatttgagtatgcaatcataccatcaacaccaactgagttatcaattgtagccagtactggtaattgaataccatatcggttgaaacgagtacgaataacaccgttatcatatatacttacatcagcataacttcccatagtgaaacgtaagtctgcaccaagtagttttatatcactttggtttgtagtactttctaatgtgaatacaccattctctagtaagtttatgtttttgaatttgttattagttccattgaaattagtatttgcattataagtactaacaccattaactgtaatagtgtcaccagtagtgtcgcctagtgttgtattacctttaacaactaaattcccgctggcagtgatgttacctgcgtttaaatcaccagttagtgatgttgatccatctacaataatatttccatgaaaatgtgattcaccatttttaaattcaacttgaactttattcattgaacttaaagaaataatattactacttgcacttatccctacgtttgtgtttgatgcattatcaaaacgtattactggcgtagctgctggtgtagcggtagtttggaataatgttaatgttccattattaattctaacacgctcagttccggctgttgtaaaaccaattgcatcatctgctggatggaatataccagtattagcatcggaccacttagttgggtcattacctgggttgttcgttgggtcaaacggattattattaaatgtcaatgctggtgctgctgcactgccatacaccaccccaaaacgcccagagccgtctgttccatcattatacatggaatcgccagttctacgtaaacactcaatcacaacgttatctatggatgtttgaacggtccctgcgtttgttctaaattggcgatgatttgcaatcattacagtattgtcatataatactgaagcagcggaaatgcttgttcttgactgacgaagacgtatattcttatcttcagttataataatccaatcgccatctgaaagtgcagtttggttcattggaacaccagatgcaaatggtttggtcaagtcagtatctgttgctaaattttcaaggccatcatgaccagtactgggaatagatgcagtaataattctagcaaaagcgtatgttactagtttagcaccagatatatttggattagagtcaacataatataaaatttcaatccaattaccttgtccagttggatttgtaggtgtaaatgtaacaggacttgtttgtggattatttgcttcataatgtgcttgtgcggcatccattataccacgcacgacataataatcaccattaagcgatggtgatggtgctggtagtggagtttgtgctaaaggtggatcgatatcatctgggatgggattatatgtaccaacaaattgtaaaccactagttactgaatctggtaattgggaagtaagaagtttaccgttcgcatctaggtttgcaaaacgtcgatatgccattgaaccatcttcaaagtctagtacaccttcaaatgctttccatcctttattgtatctaatcatccctgatctaaccacatcagcggtttctttagtcggtgctttaggtaattctagaaatgcctgactatctataattacaccaccatcacctctaattcgatttatactcatttaaatatttcctcagaatagattatatattaagtatttattttagataaaagaaaaggccaaccatagttgacctttaaaaaatataaattaacgagtacgctcaggaatatcaataccttcatatacccatacagccgcctgttgtgctttataaattgcatcttcatcagcatcaggaactgcatcaatgtcagcacattgcttatcacactctgcaaatagggattcaaccatagcaaatgcttcagtgtatagttgagtcatttcagcagcagatagttttacaattgcgtcatcaaggaaaatagaaacactatcagcacctgaagttacttgagtgtaatagttaagaagcatttgacgaccagctagatcagtactataacgatgaccgttaaacatataaccagcattaatacggtcactacgagatgatactgtgcgtgctttcagatcagatttaactgatgcaatatccatatcaacataattataagttttcagtactgttaactctttatattcaccttctgcttcttctaagaatgtaatgactggttgattactatctagtagtttaatatattccaaattctcattaattgcgttcacgttaccaacattcttatattccaaccaccagaacccctcttctttacgaacagcgttattaggttcaatttcagaaccatctttacttgaaataccataaagtgcacgaatatcgctgtacaaataacgatatgtttgttcatcatctggagttgctccagggcgttcttttaaacccttaacaccaactgggttggagatgatgttacccaattcataattttctttagaactaccttttacatatgtaaacatataactacctcacttgttaagatggtgtcaccataattgatgacaccgttttttttattttaattattaagcagtacgttgtgcaatgaacaaatcagtaactgaacttacaccatcataaattacttggtaaatggtcacgctaccagcagttttgtttagttcaccatcaacaacagcataagtaccatcagttgtaaagtttctgttaccagttgtatcttgtttaacatagatgtatactgatgcagctttaccaccaccaattaggccagtaattggagccaacgtggtatcttggtctagagtgatgaagtatacgttacttgtaccatctggagtccatgttccggttggagcaattactgatgatgtaacctgagttgggattacatcatactttttggtagttactgttgtagtagttaagttagcattagtagtggttagttcaccagttactgttactgccttatcaaacacagcattttctttaaatgatgaagttgcattaacggttagaacgtcagccgctgcgtcacctaatgttacgttaccattcgcagttagtgctcctgttactgctagtgttccacctactgttgcgttaccagtaacggatgcacttgcaagtgtagccaaacctgatgttgtaattgtagaaacggttgttgcaccgaatccagcagtgccagttgcagagatatcaccacccactgttaggttaccagcagtaatacccactgtaccagtgatgtttgcaccacttgacatagttactgcaccaccaaatgaaccagtagtagtaacttctaaagtattacctttaagtaatccagttgcagtgatggaagtaccagcagtaattgcagtacctgcacttaatgtggttccagcagctacgttgttagttgcagtcaaagacttaacagctacatcggaatctgcttggttcaattgtgcatttagtacgccagtaacagtgaagttaccgttgtttacaacgttaccattaacgattaggttgttgttttgtgaaccgacttcaccaattgttgcagaacttgaaataattgccgcaccagcagtaatattaccagcagaagataaagaatcggatgctattactgcaaacggttctagtgtttgtccaccaacatcgatatctgcgttaataccaccttcaacacgtagtttaccagcaatataagtgtctggcataatctgtacagtttcaggctgctcacctaatggtgtaccaactgttagagttgcaccagttttaacagaacctagtgttgtttgaccaactacacctagtgtaccaccaacggttgcgttgttagttactgctagaccagttcctgaaccattcaaggttgcagatggagcagttactgcaccagaagttagtgttccaccaattgttgctaaaccagttacacctaatgttccaccaagggtagtattacctgtcgcatttaatgtttcagatagagttagtgttttagcagagatatctgcaccagttagatctaagctaccaggagttagtgttccaactacagttacatcgttaccaaatgtcgcagcaccagtaacgccaagagtagtactgaaagagccacttgttgcagatacaccagaagttacgatagaaccaagtgatgcttgaccagttactcctaatgtaccaccaatagttgcattattagttactgctagtgcagtaccagtaccgcttagggttgccgatggagcagttacttcaccagttacacctaatgttccacctactgttgtgttaccaccaaaggaagctgcaccatcagagtgaatagtttcagatactgacaaactcttagctgtaatgtcagcagttgttaggtctaaaccacctgctggtgtgaatacaccttcaacagttacatcgttgtcaaatgtagctgcaccagtaacatccaatgtagaactaaatgtaccagtacttccagatacagcaccggaaaccaatgaaccaacagttgttacaccagtaatattcgcaatacctgttacactcaatggaccagaagttaatgaaccagttacacctaatgttccaccaacggtcgcattgttagtaacacccaaactaccagcattcactgtgccagatgcagtaacatcagtagtacttacaccaccacttagtgtgcttagaccagttgcagtgatggttgaagcagttgcaagactattagcagaaatatctgcaccagttaggtcaataccaccttgtggaaccaattcaccttcaactgttagtttctgaacagtactatcaccagatacatttaaggatgcagcacttagtgcagctactgtactttgaccagttacatttaaagtggtgtttactgtagtgttgtttaaagttgtatcaccggatactaatatagcgttggtattgataccaccagcatcaacttgaataccaccagtgcttacagttactttcttgccgatatttacgatatcagttagggtagttgcaccagttactgaagcagtacctgcgactgaaaggtttccagatacggatgggctaccagttacaacaccagttgttagtactaggttaccaccaacggtagtatttccagaactagcaagggtaattgctgaaacattggaagaacttaaatcaattgaaccattaacaactaggtcaccaccaattgtagcaccttctgtagtacttagggatttagaactaatatcggtagtacttaggtcgatagcaccaggagtaacagtaccagatacggtcaaatcaccagtaatagaagcacttttcgcaatgtcaattgtatcattaacagaactaatattattaacatttaatataccattaatgtttgcattattgtcaacacgtaaaccttcaccaactccatttagtacaatacttgtagctgttacttcagtagcagatacttgttttagtgtacttgaaccagttgtttcaatagtatctgcacggacagcaccaatagttgcatcagtagtaattagttttggtagagtgctagaattcactgtatcagaaactgtaataacaccagcacttgtaattgtctctgcacttgcaagagatttcacagacacatcagcagcacttagatcaactgtacctgctaccacaagatcgccaccaattgtagcaccttcagttgtggttagagacttagaactaatatcagtagtacttaggtcaattgcaccaggggtcaatgtcccagatacgtccaaattaccagtgattgtagtgttattgttaattgctacaccatcagcattgctgattgacgcagtttcaacagatgcaccttttaatacgccagtagcggtaatgttagttgcagaagtaatagcaccagaagcgttaacaccagctagagttgatgtaccagttacatttagtgtggtagcatttgcagtggttgcagttactgtggtaatattagcttcagtactggaaagtttaggtagaacactacttactgtaccttcagaactaataactgcaccagtactggttagagatttaacagcaacgtcagcagcacttagatcaactgtacctgcaacaactaggtcaccaccaatgttagcaccttcagtagttgttagagacttagcatcaatatcagtagtgcttaggtcaattgcaccaggggtaacagttccagtcacagatagattacctgcaattgaagtgttgtttgttattgacacaccagcagtgttgctaatgattgcagtttcaacagaagatgcctttagagcaccagtttcaacgctaccagatttagaaagaccagttactacagatgatgcaccagaaatttcaccagttgctgtaatagtagagccagaaattgcagtacctgcaattgcaccagtactattgattgaagttgctgtaacaccagcaagagttgattcaccagcaacagatagagttgttgtaacatcaactttgtttggagcaatatcaagaccgtcaacgtcagcgattgcagttacaccagttgaagttccagttactaccaagtctttaacagtgattgtttgaccagttacggttacatcaccactgaaagtaccagctacagcagataaatcaccactaaaggttgcgttatcaccactaacatccccagtaaaggttgcacttgtaccggatacgctatcactgaagatacctttagaaccactaacatcaccactgaaagtaccagaggcagcagataatgcaccagtaacagttgcagcaccaccaacttgtagagatgaacctacagttgtttgaccaactgattcaagagtttgacctttgattgcttcagcagcaactactgatttaggagttagatcttgtccactcacatcaacagttaggccagttacagtacctgtaaattcaacatcattaagaattgctttaccaccaacttgaagttgtggagttgcagggttttgtgttgcgttaccagtaattgttagataatctaatttgtttagaccattaccagtaataccataggtagatagtgcagcagaaccgaaggttgcagtttgtagaacgttcaacttagcaggagacattagttcagattgaacttcgtttgctaacaagactgttggacgtgcactaggtgcagtatatgcaaaacctagcttaacgttagcatcagcggtattttgacccaaattgattgctttgaatgttgcagtacttgcaagaccagtgatgtttgcacccaatgtaactgcaccagttagtgctgaagcaccggatactgataatgttgttgcttggatatcatctaaatcaaaactaccaccaatagtaccagatacgttgatgttgttaaagtttgcagtaccagagctttcgatattaggaatagttgcaacaccagttacttctaaatcaacaactttagttttacctttagttacttcaagtaaaggagtagttggtgattgaatttcgttaccggaaatagttacataatctaatttgtttaaaccattacctgtaataccgtaagttgaaagtgaagaatcaccaaatgttgcagtttgtagaacattcaacttagctggtgacattagttcggattgaacttcgttctgtagaagaacggttggtcgttgtcctggaacggtgtaaccaaagtttagtctatatgcttgacctgcttcattaggcccgatacgaatatcacggaagtttgcagtacttgcaagaccagtgatatttgcacccaatgtaactgcaccagttagtgcagaagcaccagtcacattaagtgttgtggcattaatatcagaaagattaaaagtaccaccaagtgtgccagaaatatttacatctttaaaagtagctgtgccagttgaagtaatatcagttgattcaacagaatcaaatgatcctgaattagcttctaagttatcaaattttgcagttgtgccgtcagcagcagtaatgtttcctgcaaatgtcgcagcacctgaaacatcagcaccaccggataaggttgccttaccagcaacatccaatgcacctgtgacattcacagaaccagcggtgagtgcagtgaatgttgcgttagcaaaagacacttctccattaaccgttaggtcattactgaatactgcattacctttgaccaaaagatccttacttaccgtggaattaccagatacatcaagatccgttttaatcgagtacatagagtcccctcctataacgatgaactatatattcataacccatcttttgttaatatacttatatttagtttaattcacaaaaacactattatctaatacaaaagaaaaagccaactaaaaaagttggctttaattattaatttaaaatgttatacacgttgagcaacgaaggtatcaaacacagtactgaaaccatcatagattacttggataatacttgtttgaccaactacagcacttactgtaccagaaactacagagtatgcaccaccgaaggtgaaagtcgtatcagccacagttggagttacatagatatacactgaacatgcttgaccactaccaattagacccgcgatagaatccattgtaacactttggtcaagagttaagcgatatacgttagtagtaccatctggtgtccaagtgccacctacagcagcagtagaagcagtaacactaacagggataacagaatatttcttagttaccacgttgtttgtagtgaagtttgcagtggtggtgttaatagaaccagtcactgttaggttcttatcaaatgttgcgttctctttaaatgtagatgttgcatttacagttaaagtatcagcagcagcatcaccaatcacagtgttaccatttgcagttaatgtaccacctacagttagatcaccagttacagatgcacttgccattgtaacagcaccagttgtagtaatggttgttgcagttagtgcttggaagcttgattcttctgttgcaattactgaaccatcaacatgcatgtcaccacctgaaacatcagcaccacctagtaggcttactttaccaccgaacgaaccagtagtcgtgataacaagagagttaccattcaatgcaccagttgcagtgatagaagtaccagcagtaattgaagtaccagccgctacgttgttagttgcagtcaaagacttaacagctacatcggaatctgcttggttcaattgtgcatttagtaccccagtaacggtgaagtcaccattagttactacgttaccattaacagttaggttgttgttttgtgaaccaacatcaccaattgttgcagctttagaaacgatggttgcaccagaagtaatgttaccaacagcagatagtgttgcagcagcttcaattgcatatggttctagtgtttgaccacttacgtcgatttcagcgttaataccaccgattacacgcaatttaccagcaatgtaagtatctggcataatctgtacagtttctggttgttcaccaactggagtacccacagttagggttgcacctgttttcactgcaccagtagctgttagagaagatacagtagttgctccagtaacgtctagagttccagttacacccaaattaccaccaactgatgcgtttgcagtagaagttaaacttccaacagttgctagaccagatgcagtaacagttgaagtactaacaccaccacttagagtacttaggccagttgcattaatagttgatgcagtagttaggctattagcagtaatgtctgcaccgcttaggtcaataccaccttgtgggatcaattcaccttgtacagttagtttctgaacagtactgtcaccagaaacggttagagatgttgcagatacatccgctagagttgaagcaccagtaacacctagagttccagtaatggaagttcctgctagtgtggttgtaccagaaacgttaatttcgttagtattgataccaccagcaaccacctgaataccaccagtactcactgttactttcttaccgatattaacaatatcagttaggttaacagcaccagttacaccaagagttccaccgattgttgtattacctgagatagctgggctaccagtcacaacaccagttgttagtactagatcagttccaacagtagtagaaccagtacttgctagacttgcagctacaaggttagttgcacttaagtcgaatgcaccatctacagttaggtcaccagcaatgtgtgcgttacctagtgaatcaagagatttaacggttacatcagtagtgcttaggtcgattgaaccagcagttagtgtaccagatacagctaaatcaccagtgattgcagtattttttgcaatattaagagaagcagcagttgttgttaaagaaccaacagttgcaatgccaccaacagataatgcaccaccaacgtttgcatcattatcaacttgaagaccaaggccaccagcagacaattcagcactagtagcagttacttgagttgctgatacactttgtagtacactgttgccagttgcattaatagtacctgcatttactgtaaagagtgttgcatcagttgaagtaattttagggaacgaactagtattggttgaatcggtaacggtaatcacaccagcacttgtaattgtctctgcacttacaagagatttaactgatacatcagcagcacttaggtcaaaagtaccatcaactactaagtttccaccaacattaacatcagcagtagtagttagtgagtttgaagtaatatcaacagttgttaggtcaagaccaccttcaggtttgaatacaccagtgacagttagatcttttgccgcgacaacattacttgctagatttagtgtaccagcaccagcagcttcagcttgtaaagttggaactgttacagaagttgtgattgttgcagtaccagaagacaaacgcgaaccagatactacaccagtactagttagtgttcctactttcgctgcaccagtagtagttagagtaccacctgaaacgtcaccagtagcgacaacagaagatgcattaattacaccaaatgtacttgggttagttgcactaactgattttgttactacatcagcagcagacaaatcaatagcaccagttactgcaagagaaccaccaacagttacgttaccagtagttgttaaagaagcagcacttacatcagtagtgcttaaatctatactactcggagttagtgttccagtaatagttacgttattagcaaaagtagtgtcaccagtaatactcggaacagttagtgaagccatagaaccagcaccagttactgcaagagaaccaccagatagtgcaccagccgcagttactgtattaccagatacagacgcaccagtaacatcaccagtactggttactgaactagcagttaggccagctaaagtagtgtccccagcaacagatagtgttgttgtaacatcaactttatttggggcgatatcaagaccatcaacatcagcttgggcagttacaccagtagttgtaccagttactactaaatcacgtacagttacagtttgaccagtaacgctaacatcaccactgaaagtacctttagcagcacttacatcaccagtgaaggtagcagcagtaccagttagtgcaccaacaacattagcagttccaccaacttgtaggttagttcctacggtggtttgaccaactgattcaagggtttgacctttgattgcttcagcagcaactactgatttaggagttagatcttgtccactcacatcaacagttagaccagttacagtaccagtgaattcaacatcatttagtactgatttaccagctacttgtagttgtggtgttgccggactttgtgtaccattaccagtaatagatagataatctagtttgtttagaccgttacctgtgataccataggttgcaagagatgcatcaccaaaggtagcagttttttgtacatttagtactgctggagatactagttcagactgaatttcattttgtagaattacagttggacgagcaccaggggcagaataagcaaaaccatacttaacgttagcatcggctgcgttttgtcctaaacttactgctttaaaattagcagtactattagcaccggaaatatcagcacctaaagttacaccaccaactaggctagttaaaccggatacagttagtgtgtttgcttcaatatcatcaagactgaaagtaccaccgagtgtaccagatacgttgatgttattaaaattagcagtaccagtactttcaatgttaggaatagttgcagttcctgttacttcgaaatcatgaactttagttttacctgaagttacttgtaatagtggagttgttggatcttgaacagagttaccagatactgttaggtaatctagtttgtttagaccattaccagtaataccaaaagtggataatgacgaatcaccaaaagatgcagttttcaatacacttagggtagctggagacatcaattctgattggatttcgttctgtagaattacagttggacgaagacttggagcagaatagttaaagctcaaacggtagttagtgtttgcagcattggaaccaattttaatatcacggaagtttgcactactattcacaccagtaatgttggaacctaatgtaacaccaccttgtagactggtcaaaccagaaacagttagagttgttgcattaacatcagatagactaaatgttccacctagtgtaccggaaatattcacatctttaaagtttgcagttccagttgatgtgatatcagtagttgcagtgtttgtgaatgttgcatcagttgcagttattttgtcaaatgctgcggtagtgccagtttcagcagtaatattacctttgaatgaagaagttccaagaacatccattgatgccacttgggtatcttttagtacagcagtgccagcggtttgtgttaggttacctgccattgatactgggctttggaattgtgcattagaattaatcgttgcagtatcagaaccaacaggcaaattaccaattacggaattaccatgaacttcaattccaccattcaatgatgctttaccagcaacatctagtgtagatgaaatgtctacagttcctgcttcaattgcagtgaatacagcgtcagcaaaagttacagttccattaactgttagatttttattgaatactgcatcgcctttcacaagaagatctttaccaaccgttgcaccaccagttatatcgagatctgttttaatcgagtacatttagttccctccaaataggcaaaaagcataaaatacatttgaccttgttaatatacatatatttagttattgatataaaaaatccagactcgatgaatcgtagtctggactattttttttatttaccagaaattactattttaccactaaacgcttcgtcagaagtgaatgtaacattaccacttgcatcaatttgagtttcggttattaccagttcaaatggtgatgctgctgtgctgcctggggttttatttgaataaattgaaatatacaaattatcaggtgtttggttatgttcagacgctgggatagtaatggtgtattcatcactagatactgcccaatccgcttggttaattaatttactataaggtactgtcattgttgttgctcctatgatgttgactttgacacttgtataatcagtgatttgaccaataacatcaatcgtaatgtcaccaataccactcacagtgacgttagtttggaatacagtgtcaagtgggatgttaccagggtcaccctgtagctgaaccataatatctggaccacgaccatgtactgattcaggtaaagaataagtatattgatctgctgttccaggaactaatgtaaatgccgatacaggaacgatttcagtagtaacgtaagaactatcagtacctggagttgtgctttggagaggtttccaaacaccaaggtctttaatatagatctgaataatattagtactgtcaactaagaagtaagcgtcgccatctacaccgattgattcagatggtgcaatagttccacgtaaaataccggaaccaccaccaccaccgctatgtgtattcaaataacccaatgtaaccaagtgtgtatttgcggttgggtcacctgctgaaacaggaagaagttgtgtacccgtgtagttctggatttgaacaacattaccattagtggcaatttgtgcaccatttttaccaagtatgaaggtcttcttcatggttccttctaaattagaaaaaactgccatttttataatctcctttaagatagggtgatatatgttattggttgagcagctttcaataatgcccctgctgcggtcgcagtaacaatcggatcggcaatatcgatacgatacgcattattaacaacataaactgctctagtgatatatgtttttaaatcttcgccgttttcccctgctcctgtgattaggatttcggttccagcagctttagcatattgattttcaccccatgatacacccaatgcttcgatataagtttgtcctgcaactgtttgtctaattgtgtcatatcgaccaaagaaagaaccacctactgtaacaataaattttccacctgattgtttatggataattgttccttctgggaaatatctcccaccaggaaaaacatcataaggcacgtaatactgttcaactacaggtattactacaggtccacgatgacccgttccatcaattgcagtggttactttaaagttattagatgattggtcaatacggtcaacatacattcttgagaaactatattttgatatgttacaatcatcttgaacaacacaattagtccagttggtatatgtatatttagagcgagtatataagccccctccttcaccttcagttgcaaggtgttgtccaataacatcaagttctttagtactgatattattaaacttggaagatgacggcaatccacgccattgaattctactacatgtaatattagaaagttcagtagtatttagccaattatcagagcctgaagtatacacaataatagacgactcaggaatgtggagattacataatttaaagttacgtggaggaccagcaaatttaccagatgttacaccccagttaatagaaaccatacggttagttacagatggatcatttaatagatgcccagataggccatcaataataaaatcaacagaaccataagtaattacaccagcggttgtcaaaccagtaccaattgataccaaggttgatggataaacttcattattgagaattttaaagtctttacccaactcaacgtgaatacattgacggacattgtacaagcggttattttttataacgaatttttttacatattgtgaatcatcagcattcacatcataaggaccagaacctgcaacaccgataccaataccccagtttgaaagaggaattggtgcatttgtaccatctacgttttcaatcaagttgccttctattacaaatccgtctgggtaatgtgagttgactacgttcaattcaattgcatcaccatatatatcatggatgtggttgtatgaataacgcccaactgtcattttctcaccagtgccttgctgaagaacaccgtacttacattgtgtcatttcattaaagcagaagtcgatagtacctgattcagtcataccttgcattagaaatgcagcagtacttgtaatattaataaatttattaaaataaaatttaccattaccaccaaagaattttaaataacatcctgttaatgttgcttgttggattgtactattcagtaccgataccattgtgccaccgttaccagtgattgtaccaccaaaccattgaatatcattcaaataaacagcagttctgatacggtaattaccaccagcttgaatttggattttgtgctcttttgcataaactgcacatgcgttcaccgctgctgtgtcatcagtaatgccatcaccttttgcaccaaactcttctggagttatgtaaaactgtgcctgttgaagtgttcctccagtaataaggccaatataatcagcaccgttaacactggaaagaacatttttattaatatataatgattttacccaaacatcatttgtttttgcaaagatatcaacaataccctcagaatcaacttgaaaataagtgttgttatttttaccaatgtcatttgttggtggaagtacgccaaataaagcatttgggttatcttcaagatacctaacgtttactgcggaatcatcgtcattaggagttcccaccttaacaggtaggaacgtttcgcctaaaaagtctttgattgcgacagaatcgtttacaaaattaatagaagcaccacgtttacccaacttgaatgttggcatcatggtcccttctaaattggaaaaaactgccatttatcaaccctcttttaaatgttatcttgaataggctgaataggtgcttgccatgataaagtacaaacgatcttcatttcaccaaatgaactgttgtttacggaatcattgaatacacaagaaatgatttcatctttacttgacacttcatggttggtttcgttaacaatgtaacgcattttgcggttgatatcgaaataatcaacaggtgcaattaccgtaccgccaatatcttcttgtgcttcaccaccgaaacgtacaaacatttcatttactggttcatcatatgcttgattaatatcaacttcgatattagttactaggtatccagcagggcatgtaccaataactaacaatgcgttagtccatgaatgatcaatagtgttgatgataacaactgtatctttaccaggttcaccctgaataccttgttcaccttgcttaccttcttcaccgtcttttccacggaataagataccagcactccactctttagttgggattgttgatgtagttacaatgtcaacataatacaaattaccatcagttgtgttatagaagcaataatcttgtggtagattgtcaatgcttggaaattgactaccagtactatcaatatggaaacgaccacgtagaccctgttcaccacggaaaggaacaccatcactccatgttgcagttacgctttgatagaaatataatttaccatcttcagtattatagaaggtatagttattgacgaggccagttgttggaaacaccgtaccagaactgtcaatgtggaatggcttaccagcttcaccagtatcacctttaccaaactctacacggttccaagtactaattgtttcttgtgcatcgtttgatttaaaatataaagtactagtgccgtttgcaagactaagataacaccaccctagttcttcaccaacacggaagagttcattaggaacttcaaaacctatctcatttggataaaagtttctaccgttagcaccattttgtccaaccactagacctaagtcttggattgtattgtcggaataggttacaattaaatgtccagcagagttaataactaaacttttgatgccagaattattacatgaaccacctgacccattgttgaatgaaattgtcataatatttcccttgtatgagttaatgtcatataccaatatttatcagtacaaaatacatttcgttgccattaataaataaatgaaagttcactactaaaagggcttaacaatggcattaagatcaaaagacttcctcttcaaaagaaaaactaaagatggttcatggcaagaatttcctgaatcagatagctggtatcctgctaacttagattatcattggaacgaacaaacattaccattagctagtggcggctattatggtagtactacaggattacatacaatatcctttaccctacgtaacttcattggtagaatttacgtactcgctacactggcaagtaatccatcggacgatgattggttcccaattaaatttaccgaaagctgcaacttctatcttgaatttactgataatgtcattcttaacccaaatggtggtgaccttattagagaacaaggtacaactggtacattcgctgaaaccttaaccggaaactttacctatttgaaagttggtattgaccgtgattacattagcaagtatccatctgatgtacaaaaaagtttagctggtaagttagaacaaattttaattaactactaaggattagaaatgaaattagaaacagaacaaccaaaactatttgttaagggtcatgtactaattactgacgttactgatccatctaaccaaaaaatcgttttggataaatcaaacgcaattcaccctgaaaatatgagtactgctattgctaatgcgttggcttataatcaagatagtactggtattcctattggatctattagtgaaatgcgttttggtaatggtggaacagtagttttgagtactggtcgtatcacatacaagaaaccacgcgttacttctttcggtggtctatattctcagacttatctgaaaaaaatcaacccacgtatctctgctggtattgattcacaatataacaacattacaactgttcacattccaggccaagcttacactgatatcgtctgtatttgtacattaggtttaggtgagccatctgaccaaggtgttagctctggtactagcatggatgggacatatgtatttgacgaattgggtttatatacaaatggtgatagcggtattccacttacccatattatttttcacccagttgagaaaagtgctaaccgtgttttgcaaatcaaatacacagttcgtgtccaactacaataataaggtgatgatatgagtgtaagttatacaatttatagaagtaatggtagcgtttatgctaccattccaaataacgtaatattaggaccaaaccaacctggtagtaacccagtaccgttaaactttgcaggtcgaaataaagttggttacggtcaagcatggaacgaaaacttcctccacttggttgagaacttcagtggggctactgcacctcgtggtaacgttaatggtcagatttggtacagaaatactggcaacactggcgaactacttcttgcattagttgataatgctcgtcaaccagtagatactgcatctgaagctgactgggcatctatcccaatgatttcaattttcaacacagtaccagatggcgaaaatagtattatgggtcgtatggttcttaccagtaatggtgattcccttcgtgtcctaatgaaaaataaagaatggcgtgaaattcaaacatctcgtccagaaaataaagagtactccacactacttgatatcaactatgatacaggtaagaaatatattgaatttacacaaagtaacagtactaaaccattggcttacttcaatatgggtggtacttcacaggtcgattcaaataactggacaacattcacaaatggtactggtgtgtttgaatttggtagtaactatttttatgaattgaaaattatgattcgtgaagttagtgattcaacaggtgaaattgtttctcttccatataattcaaaaacatttttcatcaaaggtcagttctatgttgataaccaaggtacatttgttcctggttcaattggtgcaagtcagattccagatccacgtcgcattacacaactagaatcaatcaaggatgtaattacaagtagtcgtccgaattgggatgtttctatggtaattaatggtgttgacccaactctcccaaatccgaatggtattacaaaagcggattacgaaaactgggtggttaactctcttaactctaataaaaacttagggttccgcgtcgatggtatagtaaacaacctttcggcaggtgagtcagttaagcttcaagcatctgttctacttaatataacaggtatcccactaattggggtataaaaagaaaaaaggagccattggctccttttttttattaatatcgatatggtaagctgttgacaaactgtgtaccttgtcgtatactttcccacaatgaatagaaatccttcattaaatttgtgttaagtaatgtgttttttgcaccaggatgtaatggtttgggccatgagccaatcttaacccatgcataacctgaactctcatgatttaaagtaggtacgaattcattttcaactacaatgacaaatgaatagtatttaaatttaccattcttagtgcagaacacatcaaatggtataatatctattatcgttggaatagaatcacctagttcttctttaatctcacgcataagaccctgtaacggagtttcattatactcaagcttcccaccaacaaatgcccagttgttagaatacgtacttctttctgatctcaagtttaacatcatgtgtccagtacttttagataaaaatatagcacctactgcttcattcataacaacacctccttatttgtcagtgaaagttattttccaatacccctgacgatatactgacataatactcttatgccatttgaatttgtcattatatctataatatccactatcttccatattataaacatagttgtgtactagtgatggctcaataagttctgctccatcattggtaattttaaacaaatagttcgctgggatttcagtctctttgtaaatgatgttatgtatgctattatttacataatattgttcaggtagtgcgttatataacaaagagcttttactaatgaatccatgtattgtataatcaacagtataattactattatcaagctgaactacaatcttgttagcatcagccccttctccaaatgaagagatatgtccttttagtgggttatcctcttctatagcttgttggaatttaatacctacagtcttgtcttcatattctgggtccaagtacttaaggtatttttcccatgaataaatcccaccatttggtgatgtttctgatagtgattgactaacaagagtaagttggtaagtatctggtatattaagttcagagtttgttatttcatccactttaatacataagttctttggtgtgaacacatcagtaatgatatcggagtaattaccaatttcaaaatcaagttcatcacgagcacctttaatattggtggtgatttgttggataagttttggtttctcaacaatagctggcaaagagaaccaaattgtggtttcaaatgtcaataccattatatccaaatcgctatcggttccttgtgggaaaccacgagtagtaaattgacagtcaatcaactccacatcactcaatgatgtccaatccaatgggttctcggagagttgtaattgaatactaggagcaaacaatgttgaaatttgctcaaatagttccattttagtttgtgtttgtgtaacccaaatattaacatcaaacgtaaatgtccaaggtactgggttatgacgagttactttatactgtttatctaagtctttagtatattcgttaattccaggggacttgttagtacccataactaatgtttcatttgcgtttgaacgaactgacttgcgatctagtttaagttggtttacactaatggtcatgattggtgctgttggaagcacgttctcactgttaccattaataattgctgctgccatacgtgaaatatctgcatagcggcaaggaactttcttatattttggttttccgtcagcatcaacaccattttgtacttgaaattcaccaaacactctgataagatgtttcagtactcgacgaaattgaccatcataataataatctattttcattctgaatccttatgtatacgatacactgtattaggtttaactgcatcatgtaatggtacacggttcgggctattaacaaattctgttagagcaagatctgcaccttcccacggttttctaccaccgtaatcgaaaatcacccaagaattcttagacgcactgtattcccatagggttactggtgtataatcggtacgatagtagtaatcaccatcaactgcatcacttgggaacatattaccttcaggaactgtacctcgtgctggaggaatcttaggacgataatcttgttgtgaatcgatatttccataaacactattagaagtgaatgggtcattaacgtaagtcacttctggttctccccatttaccatttaagtactgataaatgtgtggttctttgtattcaatataaaaatcatcaaccccttgtggtggtgtgctttctgtagtacactcaacatcacaatttagccactttttggcagatttatcgtattgatacaatgagaagccagtaacatcagcctcgttttctttaaagaagaagtcaccatccatcggtttgcgaggaaagatggttccacgcttgacttccacagaaatccatgtatcattagatagttctttcagtactgggtaagttttcttgaggaaatacattttatttgctggttcctctggtaattcgtatccatttagcatatacttagacaaatcaacagtatctggtctgtcatcgaacaagtgttcgttagtaaaatgaatgtatggtacttcatcatcagcttgcataatgatacggttcataatatccatttcattaccatagctgctgttctctgaagagccatcatcagtattaccattgccgttgtttggatcatctgggtcatcagggtagttattgttacctagaaggtcagagtactctggtgaatcagtaagaggtttaacacggagtttgtaaatgtgatgttgccatgtaactgagtaaccttctgacgttctaaacccatcttgtactacatagaagcggtttaaaccagaatctttaccaagtacatcaaaatcacgtaagttaggaagttcgattacgtcacctggcataatttttcttcccaaacgctgaatcattgtgttataatgaattgtgatgtccattgtgttaaaattgaagaacaatcctgggattttcaagtcaggtgttgcttcttggacttggtagacgcaacttaaggtgatagcttcgagattatagttacggtttggagtgtcaccaaaaattaaatcaccaatgcttgacacaacggtactatctgatccataataatcaccgccgtaggataaatcagtgttttcagcgacttgttttggtccgacataggcataaagccacatgtcaacaccaccgatgttgtattgttctgctatggcagagtcaatgaacttgtaatcattggttctaccttttttccacattctgtatgccatgtttgtctccaaaataaatcgggtatatctttatttaccttgttgacaaactcaaagaatgtgatataatgtttattaattagagtgactactcatttaggagaatacatgaatcttacccaattgttcaaaaaaagcgacgaactggcaacttctctgggccataccttcttgactattgaccatctaagtgctacagtactgacaatcgatagcatcaaagcagtatttgaagatatgaacatcgatgcagacaacctacacggtcgtttgattgcatatctgaagaatacaacattcccacatgcacctaaaagtgctgatggtgatgaagcgaaccgcacatcacttcttgtgaaccgtgtagttcaggaactttctaagaaatcagtaattgagcaacttaaacgtgatgatttctcaattgatgcttattttgtactgtttgagtgtttgtccttcccaaatactgcactagaagcagcattgcgtgaagagggtatcacttgtactgaagcagcacgaactctacagaagcacgtagaagcaatcgacaacggaattaaccttcaaagcattagtgatgaaccaactggggagaaaaaagtggcacagcagcaaccatcgtccaaacaaaaaggtttagaagattacaccactaacctaaccgcacttgcaaaagaaggtaaacttgacccaatgattggtcgccagaaagagctttctgcactgattgaaactcttgcacgtaagactaagaagaatgctattctgactggtgaagctggtgttggtaaaacgcaaatcattgatggtctagcacaggcaatcgctgatggtgaagtaccagagcatcttaaagatgttgaaattctgtctctgaacgtaggtgcactgactgctggtactaagtaccgtggtgagttcgaagaacgtatcgataacctactaaaagaactgaagaaacgtgaaaacactattgtgttcatcgatgaaatccatattatggttggtgctggttcagcaagcaacggttctatggatatgagcaacatgctcaaacctgcattatctcgtggtgagattcgtgtaatcggtgcaaccacttacgatgaatatcgtaaaaacatcgaaaaagatagtgcactaactcgccgtttcatgaaaattgatgtagttgagccaacaattgatgaaacccgtgcgattgtgaatggtttgaaatctacttatgaaactttccataatgtagagttcagtactgaagcaatggatgcagttattacactaagtgataagttcctgaagaacaagcacttccctgacaaagcaatcgacctaatggatgcggcagcagcgaaagtacgttctcgtgaaactgatgataacatcatcactgttgcactgattcaagaagttgttgcaggtatcgcaaacctagatattaacgtggttgcttgcactgaaagtgaacgtatgcgtaatctaccagatgcactccgttctcgtgtatacggtcaagaagaagcagtacagaaactggttgataacgtgatggtagctcgtgctggtctgcgtgataaatcaagtgttcaaggtgcattcatgtttgttgggccatctggtactggtaaaactgaaattaccaaagcactggctgatgcaactggttctgaactgattcgtttcgatatgtccgagttttcacaggaacatactgttgctaaactgattggttcacctccaggctatgttggtcacgattctggtaacggtctgctactcgacaagattgagcagttcccgaatgcagtactgttgcttgatgaaatcgaaaaagctgatcgtaaagtactactaaccttcctacaggttctggacgaaggacgtttgactggttcacaaggtaaaactgtttacttcaataacgtaactgttattatgacaactaaccttggtgcagcagattcaaccaagcgtagtattgggatgagcggtagtgatacagcacaagataaagcgattaaagcattcttgccacctgaattcatcaaccgtatcgatagtattgtgacattcaaagacctaagcagcgaagcgattgacagcatcattgataagttcatgggaagtttgaatgaacaaatcaaagaccgcaaagttaaagtttcactgaccaaagcggcacgtgagtggttggcaacaaatggtgttaaagttgggatgggtgcacgtccaatgaaacgcactattgagcaaaacatccgtgtcccactagctaaagagatgttgtgtggttctctggttaatggtggtaacgtaacgtttgatgtgattgatggtaaattggctatcaaacctaaacgaactaaagcagtagaaaaagttattgcgtaaaaaagaaaaggagagcaaatgctctcctttttgttatttaacttctaatagatttttaatgtcattaccacttatttgcaaactattggagtaaacagatagttcgattggataactgttaacactataacgttttagtaaattaactttacctaagttcaagccattaaatgaatatgtcacattctctttaaagtcgtgttctgcactatacattaccccacggagtaagttatttgcaaatcgtacttcaactttttcaaaaccaagagaaataatatcattcatacttgcaccagcaccagatagaacattattagtaacactatatggactaactgaatctggttgtgaaacataagtagcattttcttcactgatagcagtaatgttagttactgttccaccaactacaccaatatatgtatcactaactagtggatatgcatattcccataccccttcagtattcagtactggttgaataataccaacatcatactcgaacacgttaatttccacactatcagtcattttggttctcactaactcactaagaacacctgcaccagtaattggtaagttatatccgttatcaatggtaacaccatcaacttcaaatatctcgttagacactacccaaacatcaacgtcatctggtgtaattccatcattataagaaccaccgtatagtgttgtgtcgtagaatacttcatagttcattgcgtcgatagcataatttctatttgtttcatacaacttaacaccatcaaccaagaattctggatcagcaaaggttctaatacgaacgatgttcaatgctagaggtattgctggttcattctgttgttgtttagtgatgttatcataacgaagtacaactccagtactatctagtagttctacagttccgttcgcagtgtttcttactgtgtacaaggttggtgtggtgtcagttttgatttttgatacactcaagatggtttcccatgcattgttttggtatctcacataatcttcaccatcagttgtgaatatcataaccttatcaccatcagatagggtattgtcaattacttcagcttctgtatcactaacaattgatttaattttatagaagtatttttcatcatacttactgtatgatttactaatatcattttcaatcttagcgtaagaaggaatactaacaattgcttctgttgttttataagggttgataataaccatgccttcagttttatatctactattgtctctcaattgaactagtgaaacactattgaatccataaccatcaactgtgaagcgaatctgaccaatctttcttcctgatgggttaatatcagaaatgtcgattatgtacggatctacttcgtcaccttcaacttcccattttaactcggaagtttgtgattcaagtgctaggttatcaaatgcattcatatcatcgtagtacttagcatcggtgatgctatctaggatgtgctgataatcactgtacattgggttatttctatcaagaggtaagtcatcaagatttatttctgccaattgaactagttgaccgtcagttatgaatttgtcttccatgaaatcatcaatgctttggtcatctgggatactctcgtatacaccattaacattaacataaacatattttcgtggcatcatagtaaatgcatgaatatcaataggcattctacttagtatttcttcagccttttcataatggtcggtagcatctttatcatacaaaccacgcataccggacaatacatgaattgcgtcattgtagaatcgttgatttccattttcatctacatggcgatatgaataaacaccatattcaacttcaagtataattctaacttcatcatcagttgcagtagtattgttttctttaattaaagaaacatacttattatacaactcactactaacttcaaagtaaccaaagttataatcagtactggatgcgtaaccaaacggtagtctggtgcttggattatcatcgtaggttaacccactaaatccacatccaacctcatcatgaattacttcatcatctgcacctgtgtacaatttcaaacggttagagagtgtgttatactgaacataatgatttacgtcattaaacatttcattctgtgttgattctttatatacacgattcaacgtttctgtgaattctgctgttgctaccaaatcatctgcatgttctgcataccattggttaacaccataagcaatccctagagttacgttcaattctgggtaatacaattgcatctgataagcaaccaataggtcgaaatcttcatcactgtattctgggaatgtatatttgtaacgttgtaattcaaaatcactaacaacatcttgtgcattagattgatattttttattcacttcttccaatacatcaacacttgccaaattatcatttggtttacattgtgtgttgtcgtagtgcatgataacatcaatttcctggaaacggcgattaggtgttacgaaatcacttggtaattcaccaacttgctcccaacgttgagttacctcattgaattgagcatattcataatcccaaatgtctttttctgttttaacccaagttccatctgcaaagatatatccgtttggatctaagtcattacacaagccattaattaaatcatcatctgaagttttctgttcaatctgggaacgaatcttagttctatatggtttaacttcttcaaagtactcaacgatttgattaatcaagttgtcgttggaatagttctgtactaatgattgttctaaacctacaatataaatgtaagatgttttgaatacccaatcaacaacgctttgttctacgtgtacatacttaaccatatcaaacacaatttcactctgatgtaagtcgaatgagttcttcaataaagctagtgctttacgaacgttaatctcacgattactcaacgaaccattagcatcacgaacggtatagtcagcgtataacatatcattcaattcaactgtactattttcacgaccaattgctttccagtaaactgaatcacgtgattgtgctttaatgtacaaggtccagatgccatcaacatctgtaattctgataatgtcaccaacttgatagttcttagtgtttgcatcctctaggctggattcttgtgtatatgtagtattactatcgtagccaatatcataccaatctgctagtgaccagtactgggtcatgtccaatgaagttcctagtgcctcaacatagtctgattgtttaatcattttctgttgaccttcaccacggttttccaatgtaatggtaaccacactaccagcacttgatgggctattcattagatgaatataaccattagcatcaatatgcacaaaatatacagagctagttgatagtgggttaggtaatacaccactagtacttactagtactgcgtcgttttctttgaacttgtcactttcaggtgcaatgactaattcactattgtaagttagtacacgatatgatacttcattcgggttaacttcagtagttttaacattaaacacttcgtccattagaacagtgttagttgttatattctgtgagcgataatagttatttgcactttctacaaagtttctacgagcttcaattacatcttggaaccaagtcttattagaacctaaaccgtttggtactaaaggatatagtaaatcaattacagttcctgattcagtagtttcttgaccaatcatagaattccacatagaagtccagattgatggattgaagttatagctatcaccttctttacataattgatactggtcatgtttaataacttcagtattatccatgtaataagaaacagttaaaatacttgtgtcatcgttgacttcaaattgcatattacttagaatgaacgagctttcattgattggtgcaaaccaaggaatgttaagctgtgctggttctttaataatacgagcaatatcagtacaagatttagttctggaatgtaatggtggtacataaattgtatcacgaacccagaaataatattttgtaacataagtatcagttgtgctatcatattctaagaacgtactataattatcttccaatgcggttccgcttggtaggtacatagtgttgtttttatttttgttagcaacgtctttacagtatttgtcccagttatatggttcaactggtgaacatacccattcaagaacatcaatagtactgtgcggtaacaatctaccccagttataacgtttatattcatttgttgcatcaacatccacattaccatcagcatcatagattgcacgagtgtaatctaagtagaaagcagtgctggtgttccaccaaacctgaccaactttatcagcaccccatgcttgaatcaattcaccattgctgttgtattgtgctgggtcaactggagatgtgtaggtaacgttctgcatcgctgcaccaggaataacaccgttgattgggtcaaacacgtttaggtacaacgcagtaatgttagtacgttcatcatatgtagttggacggtcaaacaaagtactttgtggagctttaaaactatattttctgtcaatgtattcctgacgcatctcttcagtactgaatcgtgaaacataacgatacaagcgtgggcgagtatcaggatcagtgaagtcaatagtgattgaagtgtcaaacggaactaccataactctagggtcattacccgcagtataatattgactttcaattgtcaatgtatctggcataaagttagtttcatcaacaaagtaataataatcaccgtcatttagtgggatatcatcacttagagttactttacagaattgttctgcatatacatcggtattttcaattggaacgatagagagcatctcaacttcagtgtctactagttcgaaaatattccacaaattgttaccatctttgaacatccatacagaatctggaatttcaccgctgttattcatataagtgatacgatcattatatgcagtactgaaatctttagtaacgtatgaaatttcatctagtgttacagggccaatgtctggaagttgaatattctcacttcttccactacgcattgggaatgaaaacttaccatttgggcgagtaatccagcgtgggtcaaccccttgttcaccgtaataaacaataccattaccagtaccatttgatgtagcattaacatcaaacgaaaccatctgtggttgttgtttaaattggtcattgattagtttaaattgtagatttttcttaccattgatattaccataagtaccaatcttaaatgcccattcctgaagtgctttatattcatcagtgtcgtaagatttagaaacacgtagtactttttccattacttggttagtacctttgtcatgaatgaatcctttatagaaatcaacacgactaacatcactactaatcatacgttgtagataatcacgagtttgataaccaatcaagtgatttgataactcttgaagctgaacatcactcacaggagtttcactattataatataattcaaaatcagttactaatttttcaaatgatggtaaagttcctgcttctaggataatgaaaccaggtgcttgtaggcgaccagtccatgacccagtaatgtaaccatacattttaatcaattcttgaatagcaccataagttggttggtatatgtaatcaccaaagatagttttatcatcaaaaacaactgcgtgttcatatgaacttaggctcaaacgaatcaacgccatacgtttttgtgattcgggtgtagttctcactgtgaatacgttaccgatacgcgaagtttcgatttcatattgacggataccttggttttcatcatcaagtaatgaccaaacaccaccactgttctgtgtaacagattgaactgaaccaaaatctgcaccaaatttagcattagctgcacttggagtacaggatatgaactcgccagtacttaaactattctgactccaaataacaaagtctttagcaatagttgtccagtcttgttgagcaccactatcatttacatcttcaaaaatccagccatgttcttttagatattcaccatatccacaaatgaaagtataaacttcttggtatgtattgaatattttaccatattctaatgtaccttcagatttccattcattgtaatgaacaacagttctgtcttccaatttaagagttacttttcttccatttttaactggaattttatatttaaatttagcaccaactaaatcataaccatcaatttgatatgcactaccattccaagtaatttttactgcactcatttgctcatcgcgaatgttattggaacgaactagaccgatagtttggttttcttgtgaaatcaaaccgaaagatttagcagtgaatgtcaattggtctgctttagtaaagccaccaattttgtgagcaacattaacataagaagaacgaacaacgtcaccgtatttggtggtaatgttcttgttctgatacatcaaatagtcactaacaaacatttgataaccgatagtacgggtatttttctcaccatgtactaatgtagtactgtcaaagtttagacgcttacgagtttcaccataaaggaactgtgaaccatcagtataaactggtttaaggttatcattacgggtatcccagtaatagtttgcaaactgtgctggttttgctttgtatagaagaagcatttggtcataagcaaacatcgcagtgttcatgtaagtgaattccatgtcacccatgtcaccataagcccacggttctgcacgatgatccaaattaccactaacaagacctaaaacttcaggtgcaatatactcaacttcacaaatatcaataccagtactggttttctcgccagtcttagtgattttaaatggctgtacaccgaaacgcttgtatttgtcatattgaccacggcgttcacctgacaaaatagtaccagtactgctgtcaccgatagtaccatcaatatcccacaaaccacttgggaccaaatcaccactttcattcattactagtgcttcatacacataaacaacatcaccttcacgttcaccaacttgaactgcggttggttcgtattcttggttccaccaagtaggacgttgagagaagcccatcatttcccacggatgggttgctggacgatatgtgccgtattggtcagtatagattgcacgccatgaaccacgagcaggaatttcagtacgttgaccatcaacaacataataactaccagtatagttccaagttctccagttatttgcatcataatcatgagtactgttactaataccattggttgctgtgaagttaatataaccacgtagcaatagagttttcttttcttctgcactataatcagtaccagtgaaatatggagttgggaataggtcttcactgtttagtactggtttataatcaatatccttgaaagtaaggtcaatactattaaagatacgattctccaattcgaaaacaacgtcatccattttatcaacaccattgataacacggtatgcttttgaaataataccagtatgactgatattataccagctagatttactaccagcagttaagaatgttgctttttgtggtgtataagcttgcaaaatacccaagaactgtggagttggtgggacaaatgcacgaataaacccagcagtgcttgcaacgttgtcatagtagaatgggaatgtactatcacgtcccatattaatagctgttagaatcgcatctacaatgtttgatgcactattaccaagaaaagcacttgggtcttcttcatacaaacgaagcatttgagtgttgaacttgttaatgaagcggaagtattctgcttgcataaacatgattgattcaaacaaatcaatatcttcattagcggtatgtgccattagtggtaacatggacgcttcgttttgaataattttagtgcctacgccattattaaccaaaccagcagccaaacgttcttcgtaattgttaaagtcatcagcagaaccagatgtaatattcttttgaataatatcttggaagtgctgggtgtaatcaccttggttgatgtattcaatgtttgaattatatgggttattttgtaggttaattggaacttcatatgcacccaactctttattaggagtgatagtgctactataagttctgatttgtacaacagaatcttcatccaaatcaacagagctatcaattgtaatactttgtacttgattattaactacagttttggtgtattcttttatttccacaccatcaacaactagttcgataatatcatcagaattatctagtactttttgtgccaattcaaatgtatgattgtacttaacgctttgtacaccatcaccaacgataacatgccaatcaagatatgtttcacgttctgctttgtaatattgatatgttctatcaacttcaattacataagcatacattccttcaactggatctttgaaactttccatgtcataaacagtactgaatacgcggaacattactgtacgttcaacctgtggagtttgtttaacatattgtttggagtattcagtactacgaacccaatcagtttctaggttcattgtattaccttcaccaattacgttatagtaatatagtccatcaatttcaacttccacacctaaatgctcgtaagtataacgagttgattgtaggaaattctcatatgtgtaataattgtaatcacccagttcaatgttataaccataaacgctatcagttgcataattatagttaattttaaaaccaaataatgaagaaccagtaaaagtacttgatggataggtagtagtgttgtttagtttaacaccattacggtcatacaattggaattgtggaaatacgttcacggaagttttagactgtgcttgaatccaatgagaaccgtcccaatacatggaactgttaccaaattcattacctttgataataagaactacgtcaccatcttgtggttcaccactcggacggctttcagattcttcgtctgggtctaatgctagaccatacacacgtgtcccatcttgcatacgtttaacatatactttataaattcggttgttttcaccattgttaccaatactggtgaaaagaatacgcataccatcttgtggaataataccatcaatacgtataccgctgttaatatctttttgtacgatatcttctggtttaataatatcagagaacaaatcaactgtcccacggaatttagtaccgtagttcattagttctatatttttattgtattcgataattggtgcacgagcacgaacaaaacgggaatcttgcattagttcttcagataggatagtaccatcttctaaagtttcacctaatgtgtaccagaagttttgtagtgaccaagtgttaccattttctgcaccacgttccattacaatataatctggagttgtgatattatagctattcttggaatcccataggtatgaactgtagttgttcattttatttgggttaattggtggggtccatgaatagaacttaccattaaacaaacggctttcattttcggttagtgcaccgtaatgattcatatagccaactagatcatcataaaattgaattgaacgaatgctggagtcatcatttcttgagacatacgcagtggacaactgatatagttgacgtgcgactgttgactcgtgtaagaagatgttccctgctgctgccggagaacccatgtcaccaatgtagccgtcaactaattcgttttcagccggattaaaccattgttggataacatcatcactgactttctgaatatcttctaagccttgcatccactcaggcaatctttttatgaaaagcttcttctgtactgcttcagccatctgtgtaggttgaaacttaaaattattagtcatttttggactccatataattcgttcattcatttgatttatttatgatataaaaaagacgttccgaagaacgccttaatgtgttatgaaccaatgttaatgttactcttagccaaggaattgactatctgtacgttatcaactgatgcagtacttaagaaaatctggtcagaacgtgaagggatttcaaatagtgagccaaatttagagttagggttttgagctacgataacaatagtactaatatgtcgtcctaattgggagtgaatgtatgtacacaagtctgtgtaatagaaactttcaccaaaatcccagttgtcaacattaaaatactcgttagttagtgctacgacattttgacgaatttcatcatcactcattgtactgttaggcaatttgacgactttgaaatctgctttataatcttcagcagcactcgcaccaaataatggtagatattctgcactatgccaaataatactgtcactgatgactattttttgttcaacttctttaaaaatgtctttcaattcaacagatgttggcggtttaggcatattaccttgtgttccattcttcaaccatacatcaacttcagttttgtatgaattggttaatacatacatgtcaatcaagtttgttctacttgggtcaatgcgattatcatctggtgcataatgtttccagtggaaatcaataccagttcttgcattcgtttttacggtatattgtgaagttacatctttataaccataataatctaacttttggttaacatcagcattagtaccgatattaacaatagcacgataaaacgcaagttcaggagttgcagcagttgtatcatcagaataggtcaagttctcaattaattggtttaaacggtcattattattaccaacagtttgttctatgaagtaatatttaccatcgtatttaaagccaaccataaagcctgaacctttactatagataccactcaatgttgttgagcgaatagcattattgcgaacaaattcacttctcttatacgcattagtttctgcaagtgcctgatccattgtataagcccatgaagaatcaagaatagtgaaagtatcgctcggtaatgacagtactgatatagtgaaatcatcattttcttggaaaaccaatataccaccatatttaactgcatcttcaccagtccaattaggtacaatttctctgaattgattaggttctagtgggattccattactatcaacgttttcagaggtgataaccacacgagaaccatcaagatacccgttttcttgttgaattgtgtcataaatttggaaatctatgttacttgtcaacccagcattactattgcttgtggtatttgatgataaaatttcaattttgtcactttgaacactaccagtactaatatcagttatctttttagaagaaacgaagtaaaaacgaactttatcaccaccaacgaacacatattcaacgccattcgcatcaaattcccaggtttcagcagtatatttgatgttaatcataacaagaacttcatttccattataagaaatagtatcttcatcagtactgatttctaatggaatccaagaagttgtttctttatcatgaataataacaaaatctgtctttttatcaagcattgcagcgattgcttgcacttcgacactattaaaacgtgttctgtattgtaaaatgtactcttgtgcttgcatatttgatgaaactgaagtacttagaacgtaatatccattatcaagaacactaacaatactagcccacacagtagttccggcatttgaaaacttaatcaacgtaccaacttgataatttccgaatacgttacctgttgcccccataatacgaccatacgtattagttgcgtaattagaattgtattcaggtgtccatttttgttgaatttcaataccaattgtattcggtggatatgcttgataacgttgtattacagcattctcaccaatcaatggctgaatattatcaattacaatactagcatttgttttggtagttggtaattgtaaagatttattaaattgtgtgttttcttgatacattgaaccatcatcactaaacacatcagtgttttgatacttaccagttgggtcattaatatcaatgaatcgtgactgtccactatataaacggttaattgctttagatttaagaactgtgttacccaaactcaacggagcaatgttatagtcttcaccgttaacaaaacggttttgagtgtaatacatttgtggagcacgagccttaatttgctcaattgtttctgcactttgtgcacgatctgattcatattgcaatgtgaaacgaatatccaaagtactggattcgtagcttgattgtgttttggttctataggtgtattttacacttttgttctggatttcagacgttttaatgttgtatgtttcaccattactaacacgataccatacacgatacgtcccacgaggaacaacaccactacgagaatcaggatacttaatagtaatctggtctttatcacgagttgtgacagcaaagattgtttttagttgacggttaacagtattgtatgcgatactttccatagatggaactttggtccatttagtacgaacaataccatcttcgttgatttcctgaacccaaacatcagtttcgttgatattatcaacattgatatcttgaattcggttttcttctcgaatattatattggtaatcttgatatgtcaatgtcccttgaacaaaataaacaaagaaaccagtatttggtgaactaaatccgttaccatcattctgataaactatatatttttgctcttgtggttcagggtgacgctcttcaacaccaactgccgtaatatcagggttgacaacttcaaatgtcatcgattcaccattaactgtagcagtgaatgggagacttggggctgacattggaattgtattcatgcgatatagatgtcgagaaacaccattgatatcgatacgtttaaccggattaccaaattggttagtactgacaaatgaactgttcataactagaatgaagttctcataccagtttgtgtccattgggtcattccaacgaatgattttatccttaagtgattcgttaaagctattacgaacatcttggttggttttaatttctgttaattttgctactgcacgacctggatatgaacggcgtggtgagtaagaaatcatttttgcgagtttcagtactgatgcacgacgagtagcagtatctaggaagttctcacgagtgtttaaatccatacggaatgccaagttctgtcctagcatagaaatggtatctagaataaagataaactggtcgttttcgatccagtcgttgaaagaatctgggtacgtagcacgtagatagtcaatcatactttgacggattgtatcaaagtcataagctgttagattgatcttataaaagctttcatatacttgagtccaatcttcaccagcgtataaatttgattgccttttttgttgtgacataatttattcctttaaatcagtaaagtactagttcagtactgggaattatatatagaaatatttatccaaaaagaaaagcaccccgaagagtgcttttataatttacaaagatgatacagaataggtagccattctgttgttacttcttgcatcaaaaactatagttaattcttcaagagtattgagaacaacatattcaagtactatatccatctgataaccgtactcaattcttgatatttgaagtttctttaagcttaaacgtgggtccaagctaataattctacgggcatctgcttccaaaaggttgattgtattataaccatccaattcaaatagcaaatcccacgcaatgaacccataatcagcatcaaatgcacgttcacctttttttgtattgaaatgattcattaaatcctgacgaaccaattcactgtcatacaatgtttcagttcttccaactactggagttgaaaaacctttaaaaacaattgccattatgtgtttcctttattatacggattctacgatgcgagccatcttctccgctctggatgtggtttgtttgtaccacgtactatcacgcatttctttaccagcagttttataatcaccacgaccgagagcagccattgcttttttgaaatttaaaacttttgatttacccatttggaacaccataaaccacaatacacgctgaacctgtactggagcagtcattccaaattgatcatagattgattttgcgtcattgtaagcggtctgagcatcttttataaggagagcatcagcttctgcttcagtgagtccatttttgaaactttcacccttaagtacaaggtgaccgtaaccaatggtatcaagacctagactgtctttatatacccaaaacttatcatttttaaaataaccaagttttttctgatacgcaatagtaccttcaaattctttaatttctttaaaaaattgttcgtcggtatttttgatttcccatttactcataaagatttcctcattattatttatagtactgaaatatttattgacatgcctctaatctacgtgccattaattcagcacggcgtgtagtttgacgataccaagctgaatttcgaatttgagcagcagcttgcttgtagttaccttttgccatttcagatagcattgacttaaatttcattacaccacctttacccatctggaagaccatttgacataggacttgttgtgccatgtaaggtgttttcatcttataagaagcgtagattgatttggcatcatatatagctttactactatcacgaactaacatatcattggcttcctgttcggtaataccaccagagaagttttctccaccaacaatcaaatgtccgtaaccaatggttgggaacccacgactgtctaaatatctccagaatttaccatttcggtaatatcctttagcttgttgatacgccattgtcccttcatattctttcaattcggaaataaattgtgaatcaccaggaacaactttccagtcaattgccgtcttgtcaacattaccaacattgtatgattcttgtgcagttggtgcggcggtactaccacctgaacgttgtgttcttctacgacgagggacatgcctagaaccacgttgtgaatatccagtaccgatggttttaattttagtggagacaactagttcatcactatcaacagaaggttgaacaacagctttcggtgctgcttggttcgttgcttgtcctgcaattaatgttttatttcccgcttcagaacctgtaccagtctgcgatgcatagaataatccagggtcaactgaaccactaaatcctagtacgttggcagaggtaactcttatttcaaattgaataacaccattagctttccccagtacttgtcctttttgaacaacgtctttattgagcaaatctgattgaatattataaaatacagatttatatccagacttatgttgaaccaataaagcaccattagtgataacaactacaccaccatctggagctacaacatcacccttgcactgtatttcccagccacttctatcagctttaccaccaccactagtcgggacacctttcccccaataaccgtattggcgaatggttccactacacggcatgaacatatgaagaccctcatacgtaatgctataaccagtcatgccaggatcagaagtcattaaatcttgtgtttgaacttgttctgtttctgttgtataatttacatattgaattgcttcagtgtcttgtactggagctaaagttggagctacatcattagcaggttcaggttgaactggggattcactattcccactaccaccaccttgacgtggaggttcaacagtactgccgtgattctctgcatcaacccaagccgatatatcatgtatatgatcattcaagccaacagatggggtgcggaagtttggtgcattaaattcagcagtaccactattaccaccactgttaacagtaagagtttgaccaccaccactaataatagctgatgaagaaccaataagattagcactggtagcagcagagattgacgcattagaaccagcagttatatcagtactgctaccactttgcatacgtaatgaagctgctgttactaaacgtaaatctgctccagcgttaataacaacctgaccaccaactttagcatccaatgcaccaaccaaatctagtttagtgtttgcaccaacacgagcattgaagtctgctccactttcaatattatatgagcgacccgcaaccatgttaatatcttgtcctgcacgaatgttaatattcttatcacagtgcatttcaatgtcaccttcaccagtgaatttaatacgtgcagtaccatcacggttaattaaaagaacatcgccagaggcttcagataacaacaactgtgcaccactacgtgttttaattacaacgccttcatttttacgagaaccaacacgagtatcgttcactgggttattgaattgggtatcctgataaccatctggatcttgatcccatgtaggtgctgttaattcttcttctgtgtaaccatcatcaataataaaactgttaccacgaggtgaggaaagaccataaacagtactggtagtttggcgagtactgctacggttagcaacacccgcttcctcatcataaagtaagttttgttttttcagacctgcaataattggaacgtttgcatatttgtcttgagtactggtagaaattgtattacggtcataatcagttacgggtaatggcatatcagtaccagcatagttgcttatttcagtagccattccaggaaccatcgtattcatacgttggtcataaacacaaccaatccaatacgcttggaatgttcttgcttgtgcaaatataacaacaacagtacatccgacatcaggtggaaccgcccaaaaaccatatccctttggatattgaccataagcatcagcacttggtatccctggagttttaccagcgaatggagacatgtatgatgcttcaatccatgactcttttgaatttttatcactttgtgaaccttgaatccacacttttagcttaccggatttagttgggtcacggttatccatcacggttgctagttgtggatacgaagggtcaaaacgacccaactgttgttgggcatatttcttacttgtatctgccatcttaaattattccttattcaattatactatcgtgacgtttgagtgcacgaattacaattgcagcctgaatttgttgtgtaaatgaaccacctgcaccaaaatcatgaacaattttgttaacacgatatacagtttggttaaatgtagttggggtattaatatcaagaacaccagtgttatcatttatagaaactacaggttgtaatttcaataaaagatatgcttcagatgtaatatagtttgctacatggtaatcttctggattgatttccatatcttctccattaattacctgttcaagatattggatatatgaataatcactccaacccaaccagaatgggtcaccaacaacacgcatatccaatttacacaagaatggacgattgtaatagttgtcacgaattttacggcgatccatttcatatgtgctactgttatcgttcaatgatgcagacaatgttgtttcattatttgttgcttcagttggcattgtgaatacttcaccatatcgatgaccaattccatcggtcccaccgtcattttcttcatatgtagttacataatcttcaatatactgtggtagaacgtttacttgatagttattataacggtcctgttcttcagcattaccaacctgcatttgttctcttgctaaagtttctactcgatttaaaagttgctcttgatcctgtgttaatataccaccaagatcacgtgtgacgcgtaaatcacttgtttttgcccacgcatctggtatactgttgtactgaacaccttggatattcaattcttgtgatgcgtgtgtaccagcatggttcgcaacgtcctgtattggaccagggttacgagttgtagctacaaagaattgctgatcaaacttcaaatcaaggtctagaatctcactattgagtccactaaactgataattgtaagttttcatgttaatctttggtttttggtcatttgggtctacatatttctcggcattttcaaagaaatactcaaatgtaaagttttctggctgtaaatcggattcatgaacaatatcaccaattttaaaacgaacaatatagaaaacaactttgtaaactgatgtatttctgtaattatcaaatccaacatattgtttcagtgggattatattaacaaattgacgaacactagtactatcatcagcctgtacagtacaggtatctattacgtcatcgataattcgagaaattggagtacttggattccatgaaaagtttttagaaccctgtgcaccactttttgtagctccagcttctgccatctgtttagaatcatagtttataaacaaatcctgtaaatctggtgcaactttaaattcaaagaacttcccttctgctaactcaccaaatttataacgcaaataaccatattgttggtctgccatttgattcaatttatcttccaaatcaaaacaaaaatcaccaaagttttctgctgtgcagttaaatggttctttaagagtccattcaacgttatccactagagcagtacggttatgaacaagactcatagaatacatcatagtactaccactttgtgatgcactagcggtaacactgttaatcttcacggaccatttacgagttgtttctggtatagtttcaggtacaccattagtattgaatccaataaatttcaattctaatattaaaggtaagtccatgaacttatgataccttagtttattacttaaagaaattagttcatcatataaactcatactattgttttctgaaaggttcagtactgctgtgttgaagcaatagttggttgtcatccctggagttgaaggaccagcttgcgtcatctgaacacttgtgatattatactttccagttacaccactttcagagatgacatgacgttgaacttcagcatctgggtaaagccagaagtttttgaaatcatccttgtctaatgcgaaaagggaaaagtgccaagttggattgtcatactttaacaatttattgtcataaggaataacaaactcacttagatccaagtcttcatacacttggtcaacgcttgcactttgctttggtaaagactgtacgttactaaccttagctttaaaattgttttttactttttcaagatcattttgcaaagtattagcagttgcttttaagctttcaatagtacttgttgcagtttcttttgctgcctttgcagaacttgtgatgtttgaaatatcatttttaaaattatcaacagaactttgtaaatctgccatactttactccattaacctatgttacgagtaccattcaagtagttttgtactcgttgatttgagggaacacgaattgtgataccactattaaaattgtatattgggtcttctcctaatatatcaggattcaatagggcaaatacataatacagacgttcattaccatacatttcgtatgctaaacgccaaggttgatgctcatacttcaatggaattacatagaagtcgtcagtatcagcaggaaccatatcacgtggtaaattgtaaccaagataccacgtttgtttaacctttgcataaggagagtattgactatagttggacattagataaatcctccattacgtaatagttcaccacgcttaaatgcatttaggttgaactttttagtcatgtaatcagatgttggttgttcttcaagttgaagcgttacagatattttctgtggaacccatacctcatcttgtggattcatatatcctgtacttctaagctggtcgaagaattgacgactatccatatcagataaattaaaagtactatcactactattcaatggaacctgaatgtaagacacatcatttggatatgtaaaattatatgctttcaaaataacaggaatatcattatatgtataacgaccatacccacttaatagtaaaattggtggtggtgcacctgcaattgctagttcgggattattagcagatgctgcttgacgaccaaagtccattaaggacacggaacgaataaaatgaacacaagccaatgcatacattgcttcagcagcagtgttcgcataaaactcaccttggatagtgaaaacagtgtttgttgtattcttgtagttgttatagttactgttagtatgtataggggactgtgtttcatattgaacagacctttgttcagttacagttggggttacagtccaaaccaaaccatttgttggacgcagaaacgatagcaatgttggttctgaactgttgccaaaatcaccatacacatagttagcacctgcggttttaggtcttaatcggattctacgatcaatcatctttttgattctccataagaagggaacatttgatgtatttatacgtgggacaaagacgtttttggtgctataataacattgatggtacaaggaatgtacctattggatttaaaacatggagagttgaaataatgacaaataggccgaagcgtaaaaagtatcttaacaatgctgatttacttcgtgagatacaaaaaagtaaaatctcatattgctggttacttgataagtgctacagtatgtatgattatatcgtttttgatgaatccgaaattacagcagaacttttagataaagctaaagcagcacgtattaaacgtctcaacaatgaaatgcttgatgcaattcgtgaaaaagaaggtatgagtgcgaagaaagcgaaggaatacgcagatgagcacaatttagtactaactgatgtacctatcgatgaggtggttattcgtgtaattaccgatgaacatatcccagcagatacaagagtaaattttgaaccattcaaacattacattgtagatgaagaaggtattctgtatgaagttgttcgttctcactggaaaggtgatcttgaagacggagaattcagtactgttcatggtaaaatcactaatgaactaggtaaaatgttcattaaactggcagaggaaatctctcacaaatccaactatagaaattatacgtatttggatgaaatgatgggtgatgccagaatacaattagttaaaaatgcacttctctttaaagagagtattctttacaaaaaagataagccagcagtacagttgaatcctttctcttactatacttcgttcgttaacaacagtttccgttcgattcttaatagtgagaaaaatgttcgtaacatccgagacgatttacttgagatgcatggttttacaccatcacacactcgtcaaatcgaaattgaaatgaacatgattgaaaggaaaaacgaagatggctctatttgataaagcaattacatttactgatattcatttaggattaaagaataacagcaagcagcacaatgaagattgtttgaacttcatcaagtttatgattgaacttgctaagaaaaatggcattactgtatgtgtgtttatgggagattacttccataaccgcagtaatatcaacattcaaacattgaactatggtttacaaattctacaattactaaatgacaactttgataaggtttacttcttagttgggaaccatgacatgtatcataaaaataaacgtgacattactagtattaatatggcacaagtttatgagaacatcgagttcattaatgaaatcacaacatttgatgattgtactttcattccatttatgattgaagatgaatacaaagttctacctcaacttaaaagtaagtatgtttttggtcacttagagttacctggatacttgctcaataaaatggttgagatgccagatcatggtaaagagactgaaggttcttttggtggttgtgagtatgtttttagtggacatttccataaaagacaagcaaaaacaacatcaaaaggaactcgtgtaatttacacaggtaactgtttcccacataacttttctgacacttgggatgatgcaagaggtgtgatgattttagaacatggtaaagaaccaactttccattcttggtcagaagcaccaaaatatagaacatttacactttcagaactattaacagatccaagttattatcttcaagacaatacgatttcaaaggttcaagttgatattgctatcactaccgatgagattagttttattcgtgatacttttactaaactttataacattcgtgaatttaatgttgttactagcaagcaaagtattaaagaacttattgaagatggtgaaagctttgaaagtactgagtcagttgatgagattgtgttacaacaaatcatggaaattgattcacctatgttcgataaaaatcttctaatccaaatttacagatcactataagggaaatttattgtgctaaacattacacgtatatcaatgaggaacttcttttcatttggtaatgcaccacaagtaattgatttgtctggtgctgatatatcgttagttcttggtcaaaacaatgatgcagttattgaaggtggtgatagttccggtcgccgtaatggtgttggtaaaagtgccatcattcaaggtttagtttttggtttgtttggaaaaagtattggtaacgatatcaaaattccaaacttagttaataaaactaatgctaaaaactgtgaagtatctgttgagttcgagaaagatggtgtacaatatctcgtcgagcgtgggagaagtcccacgtatttcaactttattacattaggtaaagataataaggtcgaagatgagtcaagaggggagaagaaagatacacaagaagatctaaacgagattcttgggatttctcaactactatttgaacatattgtagtacttaatgctaacgtagagccgtttcttgcattatcatcacagaaacaacgtgatatgattgaggaacttctgggtatcacacaattaacagagaaagctgaactattaaaggatatgtataaagattctaaacgtttagctgaacaagaaaagttcaaaattgaaactgtggctgcaagtaatgaacgtattcaaaaaagtattgaatcattacaagaacaagctaaccaatttgagattgataaaaataatagagtatctaagttgactgaagaattgaatatctacaaaactttagacttcaacgatctctatgatttggcagaagtgaaagagaaagctcttattcataatgcttctcgtgatcaaatagaaagacgtgtgcaagagttagctttgaagtatgatgcatatgaccgtgaactagcaacagcaaaattagcattaaatgtaagtattgataagctaaaaactattgatatcagtactgaattagaaaatcacaatgagttggagatatggaaacagttggagggtattctaaaagagaataataaccaaaaacgtttcaaagaacaaaaacttaacgcattaaaggtggctttaaatggtcatgagagttcgttacgtgctgaggtggacaaattagcaacagtggagagtagtaaatgtccactttgtatgtccgaattagaacataatgaacatacttcgtctattaaagataaaattcaaaatactattaatgaacttcaatcgaaaattgatagttccacttctgaaattgaaacaatacttcaggaaattgatagtattgagatttttgatatgccacctaagcctgtgacattctattctacactaactgaagcacaaatgcatgagcataagcttcaagaacttattaaaaagagtgaagaagagcaaattaacatctatgctaatgaacttatgtcatcatatgaagaactgaacgcacatgttcttcaagaagtaccagatacattgaataaatctgaagtaaaagagttagaaatgacagtaacttcattatcacagcaattagatcgtgaattgaaaactactaacacatttattggacaaattaatacacttacgaccgattcattagtaccaatcgactatagtgactataataaccttgataagatggcaaatcaccaagatttcttggttaaattgttgttaaacaaggattcttatgtccgtaagcgtattattgaacaaaacatttcgtatctgaatacacgtcttcaatattacattgatatgtgtggttctgaacataatgttgtgttcttgaatgatttgagtgtagaaattgagaaaagtggtcagtactttgactataaacagcttagtcgtggtgagcgtacaagggtaaacattgctttatcttgtgctttccgtgatacatatgagtcattgtatcaaagtatcaatattcttatcattgatgagatgattgaccaaggtcttgattcaagtggtgttcttcgcgtgtggtctatcttccaagatatggctgctgtgcgtggtaagaatgtatatgccatttctcacagagaagaattgctttctaagactgagaaaatcctaaaagtagttaaagaggatggtttcagtactgttgagtatacaactcttgatgatgtattctaattaaaaggaaagggagccttagctccctttttttatatctaccatatttaatttgccttccttgataagctttctggcttgcttaacacgagcagcattgtttgcaccagggataacacctaattcttccagtattgcgttctgttgtcctgctggaagccttttaaacttattcgtatcgattgttagtgcagtgtgatgtataacttgctcatcttcaggaatgctgttattacgctccagataatccgcaagatttcgtagtacctcgtataagggtttatcggttaagtgcttcatatagcgattaaagctgttctgtactttaccttcccatgcgttcacttcgttctggagaacttcacgacagtgttgattctcgaagtgatagtgatcaagtactggcttagttattggttccttaattataggatcaattcctttttgcttctttagtaattcatttcgatagtttgcagcttctttactatcttttaatcttttcttcataaatccccactaaactaattcttatcaaaatatttatgcattacttcaatgttcaagaattatgtactttttataaattttttatcataatagtgagacacttttgaatttggtgctataatgttaattgtagtgatgacaatcctgttgaatgcagaaatgcatataaattagaacctgatcctatcgaaaatgtagatggcagatgagcagttcaacagtgcgatgagcagaagaaacccgttagatgtgggcatagtttgaacccctcacggcgacacggctcaataaagaactccgataagcacacagagagttcctcgatagatgtataaggatcgcaccttaccagatttgctaagggagtttattaagtgatttaataaacagcctgaagtttgattgtatagactttcaggtgagtgtcaggatgattaagactgacgaccgttgcacatgactgcgatagagagaaacagagcaacccgctttcgttcttaatgaattttaagaaattcgcaatacaataaatgctgaaaccatcagcgtcaagaattaagagacttaattgtctcttttttattgtcttcattcccctgcggggggatgaaaatgtcttcaacaaatcccgtcaagtattaaatcttttaaagttctttataattaattataagaaatgaatatgagttacgtagtaacgaatattcttcagctaacgaatgaaatgagttagatgagttcactataaaataattaattcctttcataattcaattcaatcaattctgtagtttaaaaccaaaaaaaaaccagcaacaatgtgctggctccttgtgagttagtgcttctcgttttgttttttaattttcttattaaaagacttaactaataagtctctatcaattagtggcatattaagtagtgttccgtaatcaacactttccatataaacagaacactccattaatgcagttttaatatctgacttattcaactcaaattccttaagtacttcttgtatttcttcaggagatgagtggagaagcattatgcgaaaaaatgacttgggtcatatttcagtccattaatttcccattgatgattacagtcactgcattcaacttccatagtatgggaaacaccaatttcaagtacttcatccattttttcacgaattattttaagtgttcctttggactgctgacctagccattcagaaatgaattcgttttcagttacttcatcaccttcaggagtaattactttagcaataactcctgcgatcatatcaaagttgagttgtgccatactttcaaatacttcaccaaacactttaactttttcttcctgctccatttcggcagtttcaaggaatttagttttttgttgttctgtaaacattctttctgcgaagttagaatattccttccaagtaagtggtctaaactctaaacttagtccattatccaattgtacagtaggaacttcactgaaagtttgtgctgtttctagtagatatgacaagctacgctcaaaacggccttctttgttacattcagggcatgtcacattaatatcatatgattcttctttagaagctactttaatagcgataagtaattgctctacgtcatttacataaagttcatctgcatcaagtacgttaggtacgcagttttcaataacacgagcaattgcatcaccatttagaagcatatctggtgtattgagtgtcatttcatcacgtgcactacgagcacaaatgccacatttgatacctttagagccaagaactccttctttataaggaatcacgccatttgtgaccaattttgtaccaagttcttcaattttagtatacttagctagtgggttcattgccattttattaaatctccatgtaataaatgtctttgtagtatttattaccaaaaaatgggacaaattggacaaatgttatagatgggtcttttttattcgttatagattcataaatatttctataatacatctattaaaagggaatgttatggctgtcaatacaagtgattacctactacagcagttggttaatcaaactaaagataacaatgatagtttgactgctatccgtgagttattagctgaaaatataaaaaatgataagaaaaaatcaggttcaaatagtaaaaagaatggttccagttccagttcttccagtaatcgtggaaatcgtggaagtgcacaagccgatgatgggaaagcatttggtaaattgttcaaatcactatcttctgaagtttctaatgtaagcaaaacaatgatgaactccagtacgaacgtaagtactgtagtaaactcattgggcgttagtgcatcctcatttgcaggttcattagcaatgatgccaggtccaattggtgcagcggcagcagcatttaaactcgttactggtgctggtcttgctgtatacaatgcacttaatgcacaattggaagtatataccagaattaacagtgctggtgttgcattggctgaaggttatggctcagtactgaaaggtgcaggtgcatcgatgttgagtatggatgcattcagtgaagctctacaaacacatagttctgtagtagctcaattggatggggcatatggggatggtgttgctacctttggtaaattgttaggaactgttcaacaagctcaaaatgaacttggcctttatggtatttctcaaaaaacattaactgatttaactgcaagaaacattaagttccaaaaacaatatggtggtcgtgaagctcttcgtagtatggaccaagctaaaagtactgaacaattcatcatgagtatgactaaattcagtaaaagcatgggtgaatccgttgatgcactattaaacaaaacacaaaacctagataaatcactcgatacacgttctatgcaaattgcattgcagaactactctggactatccagtaaagctgctgtagcaacatctaaggcgttcaacgaagctgcgggtgcaatgggtgatgcaggtgcagatttcctccgtttgatatcacacagattgtctattggtggcgtaccggatgacctactcactccagtactgaaccagttcgctgatttaggtgaaaatcttgtgcgtagtggtgtaactgattcacaagaaattcgtcgccaacaattagaattcgttaaaaagaataaagaattaattaagcaagatttgcttaaccagattcaattaggaaacacaacggctgcaaccttctaccaacaactattggatatggaagctacagtaaatgatcctaaaaataatccggctgataaattaactcaatttactaaccgcttcaatatgtggattagtaaagaattcactgaaccatttaatacaatgtatgctaatacacaaaattcaattgtggattatctttcagacattgcagacagaactgatggtgcatgggagtttattggggaattggctcttgatggatttggattagtacctattgctaaagatgcaattgcttaccttgatcgtattggtgctgaatttacagcttggttggatggattgggtgcagatatattcggttcaggttactctaaagtgtcagaagcatttgatacctttatgaataacttaatggatttacctggtaacctatggaattctgttaaaagttggttcggtggtggttctgataatgatataaaactcaataacagtactgaaaccccagcagaaagcgtaaacaacatcattgacaacggtgtaaatagtgttagtgattattttgcagggatgtgggataagttcaacaaatggaacaccgcacgtaactacaaagaaccaaaaccactaccatctgattatgctgacagtttattcaaccgtccaggagtagaacgtattcgtcctgttattgaaaaaaccaataacgttgctccagaaataactgtatctcgtaaagattttgataaaactgcatgggcaccaggtgaaccaccagttccaccaaaacctgacgatacagaggcaattaagaagatgataaataatggtagtgcagtgacatcgagaactggaccaccagcaccgatttctgatgaaatgaaagaaatactcaaaaagcttgccgatgttaatgaacaatcactatctgctgtacaacagacaaataattatctaagaactatctctgaaaacacccaaggtgagagaaacagttaaggacgaacaataatgagttggaaacgacatatgacaatggggagatcgaagttatcggtcgtccctaatcagtccagtaatagcaacaaatcaacaggaacgaaaacaaatttcgcttcctatcttccagtagtatacaatggtttagctaaccgtactgaacgttatagtcagtatgaacagatggaccaagatcctgaaattagaacagcacttaatatcattgctgacttctgtacacaaagtactgaagattttggtcttccatataaaatcaaatataaagatgatattggtgatacagaagtaactactattgaagaccgtttggatgcatggactgaacaaaatgattttaaaaccagaatgtatgaaattgtacgtggcctattaaaatacggtgaccaattcttcattcgtgacccagaaacatttgactggtactgggtaagcccaaaaaacgttgaacaagtattcgttaacgaagcaaccggaaaaacccctgtaatttattatatccgtgacgtatctttgaatcttaaagataaagtgtttagtaacttgcaagttggttttgacaaaactgcatatcctggtgcaatccctaccacattaggtggcggtggttcagtagcagcaggtggtgcatctggctttactaaccaaggaaactctgctgacccattcagtacgaacggtcgtcttgatgttattccagttggtgcagaacacgtaattcatctaaccctaaatacaggacaagatggagtttggcctttcggtactagtatacttgaagatgttttcaaagtctataaacaaaaagaattacttgaagatagtattattatctatcgtgttcaacgtgctccagagcgtcgtgtatttaaaattgacgttggtgatatgcaaactcaccaagcaatggcatacgtagaacgattcaaaaatgaaattcaccaaagacgtattccttcaaataaaggtggcagtacttctctaatggatgcagcatataatccattaagtattctagaagattacttcttcccacaaacttctgaaggtcgtggttcagatgtacaaacacttcctggtggtgataacttaggtcagattgatgacttgcgttacttcaacaataaattgattcgtggattgcaaatcccagcttcatatctaccgcaaggtccagatgatggtggtgtatcactatttggtgatggtgcaacacaagcaatggcaagtgaattacgttttaataaccaatgtatgcgttatcaacgtttggttgcaaaactatttgatgcagaatttaaacgttttatggttaaaaatggatataacattagtacttcatcttttgaagtaattatgaatccacctattaacttggcttcttatcgtaaagcggaactagatgctaaactaattaacacctatctcccacttaacgatctgccatatatggcaaaacaaactattcttgaaaaaatgggcttctctaaagctgatattgttaagaatgagcaaatgtggctccaagaaaatccacaagatggttccgctccgtcaagtggtgaagaagatgctgctgggttgcaatctgttggtatagatgctcctaacgatcctggtatggatttgggtattgatggtgacggtaacttagaaagtgccgatgctgaataccaagaacaacaaggaagtgcaggttttaacccgaataatttaggcgattctttttaatcataaataacaatgtataagaatgagggtacattagttgccctcattataatgcatattcaaaggagatgaaatgttaaaggacatctttgaatctagcagtgattctttatacgaccctgaagatgatcagaacgtatataaaattactgattccagaaaaccaaaactaacattacaagtacttaataatttaagaaagtaccgtgaatttaaagctaatgaagaacaacgacgcaaaaatgttgtcgctgttgtttatgcagcagcaccatccggtgatggttcaggattaatgtaaacaaaaatcgcactttttaaagcttttaaaaatggcgaaatttttcagtactaaataatatcatactttatatgaatgtaatatatctatggaggatataatggcgaatttaaaactactacaagaagcaattgaagcgtttgcaaacggcgaacaagatgttgctgataaaaaaatgcgtaagtactttgttgagcaagctcaagaaatcaataaagaactagaagaaagcatggacgaagaagaatgtgaagttgaagtcaaagacgaagaaaaacttgacgaagactttgatgttcaaccagacgctggtctaaatgctgaaatcgaatacaccctaggtgaagaagatgaaagtgcagaagaagaagttgaattctctgctgatgctgatggcgaagaagttgacgctgaagcagaagttggtgcagaagttccttccgaagaccaatgggaatctattcaagatgctttccgtggcctacaacaaatgtttgacgaaatcggcggtgatgaagttgacctaggttctgaagacgaagttgaagttggtgcggaagaagaattcggtgctgatggtgaagaatctgaagacgaatttgctgatgtacaattcggtgatgagaaagttggtgagtctttcaaacttaagcaagttgctgcggttgataagaaagaaaaagctggcgttaataccaagtctccagttgctccagaagctaaatctccagttcaaggtgttgctccagtgaaattcgcaaaagcttccgaaaaacaagtagattatgattttgaaaacgaagatgctatgtctcacactgatgaagacctaggtaaaaatgctcgtggcgaaatgaaagatgttgcgaagccaaaaaataccgcttctaaatctcgttctccactaccaaaatcacaaccaaaaatctaacactaaataaagaaaaggaaaggagatcattatgagtatgattcgtgaatggtcttcattcaatgattctaaagttgttttggaacatcgtgataatggacttggtgggcgtgattgctatcttcgtggtattgctattcaagccgatcaaagaaatttaaatgagagaatttaccctttagccgaaattactaaagctgttaataatatggctcaacgtttggctaaaggtgaaagtattctagttgaatgtgaccaccctgaaacactaacaattaaccttgaccgtgtagcagcaatgattactaaggtctggatggaaggtgctaacggcatggcagaaatcaaactacttgatactgctcatggtactaatattcgtaaaatgctagaagctggtgtgaaacttggtgtaagttctcgtggttccggtaacgtggattacaatggaatagtttctgattttgaaattatcacaattgatattgttgctcaacctagtgctccagaggcataccctactgcggtttttgaatctctgatgagtaagtacggatcaccttgtaatagtcctaaaaaaatcacagaatctaaaacagtaaataatgtagattctgaaatttacgattttttcaagaaattaaaaggttaacattttaaaaatataaatatttgtatgttgaagtacagatatttcagtacttaaaggagagaacgaatgtctaaattagaaaagcttctaaaagaatcatctctttctgatgaggcaaaacagctaattcaggaagcatggaatgaagaaaaaaacacacttgccgcagaaatgcgtgaagaaatgaaaggccgctacaaacaagatttgtctgagctaaccgaaggtctaaatactatggttactcaagttatcgctgaagaaatgggtgcagtatatgaagagaaaaaacgtcttgtagaagatcgtgtaactctccgcaaaaccctaagtaatttctctgcgttttctaactctgttttggctgaagaagttaaacaaatgcgtaaagaacgtaagcatcttcaagaatgcatgggtaaattcgttaatttctctaacggtatcctagcagaagagttaaaagaattccacatcgagaaacgtcaactagttgaaactcgcgttaaactactagctgaaggctcccgtcaaattgctgaagcacgtaacaacttcatcaaacgtacatctgaaagtgctgctaaatatattgcagaaactactcagaaaaacctatacgctttgaaagaagatcttgttgaagcaaaacaaaatatgtttggtcgtaaaatctttgaagcatttgctcaagagtttaatgtcaaacaatttaatgagaattcactactacgttccctaactgaatcaatcaagtctaaagaagacgaaattgctcaagttaagaaagaactaaatgaaactgtaagtgaagttaaagctgctaaaaccaaactacgtattatggaagattcacaagctcgtaatgcgattatgtctgaactagttaagccactaactacacaacagaaacaaattatggaatcccttctagctacttctcctacagaaaagcttaaagacgatttcagtaagtaccataagtcagtacttaacggtactaaagtaaatgaatctgctaccactcgtcaagcagttcagtcttccgctaagagaactcttgcagaaggtaaagtaatcactggcaaccgtcaggctattgttgaaagcgaagaaatgaccgctgacgatatggcattcctaaaagaactcgatgttctttctggtatcaataaaaaataaacattttaaagcattttaataatcaaatttttcagttctataaataatatcatactgaaaaacgaatataacatctttaaggagataataatgtcacaactactaaatgaatccaaatgggtagcagttaaagagaaactagttgaaggtctacaaggtactcgtaagtccgtaatggaaaccgtacttgataaccatcgtaaactaatgctaaacgaatctgctacttctggtgcaaccaccgctggtaacatcgctactctaaacaaagtgattctaccaattatgcgtcgtgttatgccaaccgtaatcgctaacgaaatcatcggtgttcagccaatgactggcccagttggtcagatccacaccctacgtgttcaatatgctgacaacgctcctggtgttatcgctggtgaagaaatgctttctccatacaaaatcgctaagtcttatactggtgacctaaacgcagacaacagcaacccacaagctgcccctactagccaactagaaggtactatgggtcgtcgcgttaacatccgtattctacgtgaaactgttgaagcgaaatctcgtcgtctatctgcacgttggactgttgaatctgcacaagatgcacaatcccaacatggtatcgacgttgaagctgaactaatggctgcaatcgctcaagaagttaccgttgaaatcgaccaagagctactaagccgtctacgtgcactacctggtgctgctgctgtaacttatgaccaatctaaagttactggtgttgcgaccttcgttggtgacgagcacgctgctctagctaccctaatcaaccgtcaagcgaacgaagttgctcgtcgtaccaaacgtggtgctgcgaactgggctgttgtttctccaaccgcactaaccattctacagtctgcaactacttctagttttgcacgtactactgaaggtactttcgaagctccaactaacgttaaatttgttggtactctaaacagcaccatgcgtatttttgtagacacgtatgccagcgatgtcgaggacattttgattggttataaaggtaatgctgaaactgatgctggtgtgttctattgcccatacatcccactaatggcttctggtactgtaatggaccctaacactggggaactcgtaacaactttcttaacccgatacggttatgttcagttgactgacagtacttcatctcttggtaacgctgctgactactacagcaaaatcgctatcaaaaacgttactttcatgtaattgtaatagatttaaaagatttaatcaagaaattaaaaacaatagggactcttcggagtcccttttcttttgtaaatatacttgtggtgtgcatcattttgtgatattattattttattgtaaccgaggattttaattatggcttcaaaattagatgaacaacattatgtggataagatacttaacataataaaaactaataacttaaacattgtatttcataaaataattaattttaaaaatgccaaaagtaatttttcatacacatgctgggattgtaagtcttctatattgtcatgtagtatagacaacttttcatcgagaaaaaaatgtcaacattgtggtataatgaaacaacaaaatggaactagtgtcccaaaaactgccagccaatacaaacacgcatgtttaactaggatagcaaatgagaacaaaccttgggaattcgtacaagtagttaaatttataggtaagaaaaaatccgatgttgaatttaattgtaaaaaacataagaagcatttcgtcttatcatttgatgaatttttaggtaggtttagtggatgttatgagtgtggtaaagaacgaacgatttcttccaaacgaaaagatgctaatgatataacgaaagagttgaagaaaattcatggtgacaagtacacctatgatgattttcagtatgacgaaacttatgattatcaccatactgaatgtgtttttggatgcacactacataaagatgtaaaaatacataaaaccctagcgaatttcagaaaaactgatagagaacattgtccagtatgtaacgaaagtgaaggtactatgcgtgagccatcaactttatatgtacaaaaaataactcacccaacaaaaggtgtattttataaattgggtgtaactaatgatatcaaccgtagaattagtcaacaaaaacattatgctcatactgaacacgatgttttgttaattgaggactttgaaacacgaagagaagcacaagatctcgaacaaaaaataaaaggtactataactaataaagttgttgaaaaagaagattttccagatggatacactgaaactttcaatgaagaagatttggatttagtactatccatgataaaagaatggaaaactaagtaaacaaccataaggagttgacacggatgttaactgtatacatttttaagaaagaagagtacttaaagagtcagtactcaaaaattgagattaatgttccatacggaactttagttggttatgatgaagctagtgaaactttgtattataatgatgatagactggactatagtattgattcatttatcgaagacatacttaatagtaacactgaagatatgttgtatgaagaatacttagataagtacaaagaacgtatgtcaaagttacatgctgatgctcccgtactgaacatttcaaaaactccttctgaattcgagccacaaaacccattccaacgcctaattgatgctggggtaaatttccgaattacttgattaataaatatcttcatattactgatggagatattttctatgtcacagatatgttatgttatagtaaatgatgcgtggcctgattatgttaagataggatttaccagtaaatctgaaatgacagaacgtttaaggacatatcaaactgctacaccttttagagattttgtggtataccatgaagtacactttgaagatgcacgtttagcagagaaagaaattcacaaaagactaaaacaaatgaacgcagtaaggcaacctaacaccgagtggttcaagatgcctaagaagatagcagcgaacatcgtcgattctgttcttgacgatatggaaaacgacttgctatagtaataaatatagtatatattaatcattaaagggatttatacatgagcataagttttaataacccactggatactatgactagtactggtgctaatggatctttagaactaatagtgcttggtggtacaccaactaatccaagacctattcgttttaattcatcttctgtcattttaccagtacaggcattgccagcaggtgagcaaggtgcgatggtatttgatagaaatgagttggtgttaaaataccacaacggtacaagttggattgcagtatatgatactgatacaattcttgaaccaatccgtatttcactcgatgaagtgaaccgtaaactgaatttaaaagttgaaacagtaacatatagtagtagtgctgttccaagtgcgagcattagtggtacgaatttaaatatcgtattccctattccatcaagtagcggtactggcccaacaggtctttatacttcaatgaagcctggtgcaattacccagtactcattgacttctggacaaactgttgctagtattcgtgaacagatgtctggtgtaaccaatggtcaaagtggtcgtaatggttcacaaggttctccgtggaaaacatctgatggttggtgttttgctgatggaatgtggtggcaatgggttggtgaaaatggtacaatcacaaaacaagttccgaatcttaaccaagaagcatacttgaaaggcattaccacatcaggcgtaactaaaactgatagtgtgattgcaagtagtgcatcaattagtggtactgcgatatcaattgctcaacttccacctcactcatttagtttcagtggaactactggtgctgctggtcgtcatggtcatagtcaggcactaaaaggtatggacagaagtggtcttaatgcgttaacatccagtaacgacaacggaatcccaactgtaattaataacattaacgaagcacctgatcacgtgcatagtttcagtggttcaaccaataccgttggtagtggtcaagcacacagccacggaattagtaatattgacgtaccacacttcaatgtggcatacttatataacattgctgagtccaacgttgctttgagtgaaaaagttgcaaacacccgttatgtactgaaaactggtgatacaatgtctggttcattgagtattgcaaacagtgcaacaattcgttcagacgacacatctttggtactttacttccgtaacgcggcaggaactactgaacgtgcagcaatttatcatagttcatcaacaaatacattacgtttgagaagtaatggtggttcggaagttacaattaactcatctggtgtactaacttctccatcgttggttgttagttctaactctgcaacagtatctggtaaaaacattgtacgttcagttaacggtactgcggcagatgcaagtggtaatgtaactatatctaccacaacaacttctgcgtcgttgacacaaaatggctggtataaagataacaatactggtatgataacccagtggggatacttggcagtaggggatgactcgtatgtaactgtaacattacctataccatacccaaatgcttgtttaaatctacaagtaactggtagagtatcaggtcgtccagataatgatgctgcatgggcatcacatggtaatattttaagtaactcacagattgctgttggtgcagctaacccaaatgatgataatccacgtggactgggcgtgtactggacaacaattggttattaaaaaaatattgagacaacttttaaagtagtgatacaatgtagtcatcttacagcggttgtgagatgacattttttcaaaacacatggagaagcaaacaaatggcaaaagctaaaaaagaagttaaagttgaaattcgtgacctaaatgatgaacaacgtaaacgtctaggtgatgcactaaacaacgcagtagtacaacttacttttattgacgataccaaagcatcctatgcagatttcattagttccatctctgatgaactaggtattgatgcatccgatatcaaacaagccgctcaacgtatctacaaaggcgattactttgataaacaaaacaaactcgataacatcgaaactatcctaagtgttactaacaatttgccacaagcagatgacgattactaataagtactaaaaactaaactttatagcctccaatgaatgggggctttatttttaacttaataaacgtaaaggaatacaaacgatgtatatcgatgcttatatggaacgtaaacgtactggtgatattttgcacgtagcagaacgtaaaaacggtaaacgtattctacgtcagttggacccagtatatgaatattatgttgaatgtcctactggtgaacacaaaacaatttatggaactaacgcaaagcatttggagtttgaaactcaatcacagatgaataaaagcgttgagcaacataaaaatgaaggtctgcgtatttttgaaagtgattgcaacattaccttcaaaacgttggctagagaatacatgggtaaaggttcgccggatttgaacgtagcatttttcgatatcgaaaccgacttccataagaagtttggttatgctccaccatcagatccattcaaccgtgtaactgcaatttctctatatcaatcatggactggtaaggattatgtactgactttgccaccaactgatatggaaatgtacgaagcacaagatattgttcgtcagttaaacgaagaaactaacgatcctaacagtactgtcatcctttatacggatgagaaagaaatgtttatggagttctttagtctaatcgatgactctgatgtaatttcaggttggaacagtgaattctttgatattccatatatggtaaaccgtaccaagaaaatcttcaatgaagcaactactgctcgttggtgcttgtggaataaaaaaccaaatgctcgtgaagctgataactttggtaaaactgtagtaacgtatgatcttattggtcgcgtacacttagactatcttgctctttataagaaacatgctggtcaagttgaacagtcgtacaaactagattatattgctgaaaaagtaactaaagaaaacaaagtatcctatgaaggttcattggataaattataccgcgaagattacattacattcttgcgttattctaagcaggatagtattcttctaaagaaaattgatgctaaatgtgactttatcaacctgcataaccgtcttgcacataaagaatgtgtactaattagtaccacaatgggttctgttgcactaatcgacactgctattatcaacctcgctcactcacgcggtgaagttgtttttaacaaagcaccgaaggatgattttgagttagatccagagatggagtactatggtgaagaaggtgatgaagaagatgagaaaatcagtgcaaaagctgctggtgcatgggttcaagatccagttcttggccttgttagcgatttgggatgtacagactttaactcattatatccaactgtactacgtacacttggcatgagtactgaatgtattcttggacaacttcgtcaagactacactgatgcatatcttgctgctaaagtacaagaacaaaaagctaaatccaaatctaaagcgtttgaacctgattggaccgcagcatggcatggtttatttgctgctgtagaatttacaatggttcatgaaaaatctgacaaaactttgattgttgatttagaagatggtagttcgttcaatgcaactggtaaagaattgtatgatattatctttgctgaagacagtactattgtactaagtgctaacggaacactttttgataagtctaagtatggtgtaattccagatattcttactcaatggtattctgagcgtaaagcacaacaaaaaatggtaatcgactataaacacatgtatagtgatgggtgggaattcaatggttctgagaaggttgaacctttgctatctaactacacaagtggtacaatgttccgtacaaacttacatgacaatgatcctgtttatctattacgtattgctattggtaaaggtcaatgggaagaagttgcaaaactcattgtggaaaatggtttagtactgaaagatggtcgtattttctgtgcaacggaagataagaattacttcaaacagcaaagtgcattctggaaacagaaccagcaaattcgtaagattcttctaaacagtctatatggtgcactattgaacaaaggttcacgtttctttgataagcgtttaggtcagtccgttaccttaactggtcgttctatgactaaacatatggcaagccgtatcaatgaaatcactactggtgtttataatcatcaaggtggctctgtgatttacggtgatactgactccgtttacttcagtgtaactcattacctgaaagaacaaggtattccatataatctttctaaagaagaaatcgttgacatgtatatcaaaatcggtgatgaagttggtgaatcattcccttcattcatgaacgaaatgttcaatactggtattgagaaaggtaagattgttggtgcagacttagagatggtcggttcccgtggtctattcctgaagaaaaagcgttatgcaattctcaagtactgggaagatggtttccgtaaagatgttgatggtaagcctggtgaaattaaagcgatgggtcttgaaattaaacgttcagacacgccaaaatacatccagaacttcttagaagagactctaattgcattgctggtgggtgagtctgaagctcaacttaaacagcgtgtacgtgactttaaagaggtatttaaagacatgccagtacacgaaaagggttcaccgaaaactgttaagaactataccaacttagaagcagaatatgaagtttctggtaaatgtaaagttggtcatgtattagcaggtattcaatggaaccgtctacgtgaagtatatgatgacaaaactgtacctgaagtaactgacggtacaaaagtaattgtatgtaacttaaaagataacccgatgggtatcaaagcagtaggttatccaattgactgtgtggaatatctacctgaatggttcttagaactaccatttgatacagagaaaatggaagaaatagttctaactaaaaaattagaaaacatttttggtattctggatatggatattggtattcatgagaaaagtacagcagccgttaataacggattcttcacctggtaaggaaaatattatgattattgcagacgaaactaaactaaaatatgacgaagtaaatgacgtattctctgatgaatcactagcactgtcctcagacagtgttaacgaggcgtgggaacagtacgttttatggagtgcatcccaaggagagtaatatggaaaatatctataagcgtgttggtgcagtactggaagatagtactatcgtaaattcagtacttgcatacaataatgatgatgaagttgttctaatgtctgctggtttcaccagaactggttctgttgaaatcgacggtgagattgttgacgtctattctattgaaaagaaacgcaaagttgtcattgttgaagatgttaacacgttaaaagacttagaacatctacgttacaaattcaacattggtgcaggtgcaaacgctgataagccgtaccttaaacgttggaacacaaaatactgataaaaaattgagacaagcatcattcacgagatataatggtgcttgtagtaatctgaagcatacaaaaacatttttgattaacaaataaaacggagaattatataatggatctacgcaacgtactacgtgacctagttaacactaccaacggcatcgacttttcttgtatcgcagttagcagtgaagaccgtggtgatggacaacgtgtttacatggaagcatacaccgatgaccgcaccctagttatgcgtgctcacactaaagaagacgtaccagaagttcaaggtcgttttggtcttggtaacctaggtcttctacagggtctaatgtctctaaaaacttacagtactgaaggaactactatcacttctaatttgaaagatggtgcagttaagagcctagcattcaaagcagaagatgcaagcactactttcatggttcaaccagaaaaactaattccagcccagcctcgtttccacgaacaaccatatgacgtacaggttacacctagtgcagctaaagttcaggaactaaaaagcttctctggtgtgtttaaatctttcagttctctagtaactccatacactgaaggtgatactctttacttccacgttggtgagaagaacaaaagtaaccacgttggtgcactagcattctctaaaactgaaggtgaactaggtcttggttttggttataacattgaccgtgttctacaagctctatcccgcgtttctaacgcagaatctgttaccctaggtattaccaaaactggtatgctaaacgtaactctagacactggtattgcggtatacaagatttacgtaactggttgctaatataaataatggggaacatggagttccccaaatttttgatttaaaaataagtaaaggaagacaaaaatgccattatatacatatcgttgtgaaaaagaagaatgtaaacacagtttagaaaagattgtaaaaattgccaatcgtgaagaacctcatgattgtcctcaatgtaatggtgagaagactatgaagttggaagtttttaccccaggtgataaaggtgcaaatctttatttccgtggtaaatggtttgcaaacactggaggttactgatatgaaaattaaaatgattaacgattatgtactggttcgtcaaattgaagcacagaataaaagtactggcggtattatcctaggaaacgttgaaccaccatgtgttggtatggtgatttcagttggtgaaggtaaagtactacctaatggacaaattgcagaacataatatttgtgttggtgatatggttgtatttggtcgttcatcactaaacactcctatcactgaagatcttggtggtggtgaagacacatattatgtgatgaaaattgaagaaatttttggtaagaaatcaaatggctaaaaaaaggtttattcctttctggatggtccccgctcattggggactttctggtaaagcgaaagagattgcgaaagcatactactataacgatgattatgaagctgatatgttagttgcagaacttacatatctaacaccatatgaagttgatgttgcacagttggatatcaaaaagaaatacaatgtattagaaactcttgattatctaatagcacaggcagatgtacaattgaagtattccaagattacccgtgatgagtataatgtaaaattacttgatgccaaattgagtactggtgcaattactcaaaaagagtatgatatggaagtaatcgaactaatgcctgatggtgatgacaaacgtcttaaagctatcgagtttgcatatcgttatgaagagattacacaacaagagtattcaaaggaaatctttactttacgtaaggaaccttggatagatttggatgtagtacttaatccagaaacaaatgaagttgaatttgtttttgattataatgaatacttttggaaaaagttaaaagcggaaggtcatccaggcaatgacgaagaagaaattattgacaacttcgttagagacatggggcgtaaactagctacggatgatttcagtgatgattatgacgtaaagctagtgaatgcgaacgaagggttagagaatctacctggtttacctgaagggtttcgttcatacaaataaaaaaaggagagcaaaagctctccttttcttttatctttaatttattaaaccatcgctgggatgaatttgaatagtttgataccgaagtcaccagcagcatcagcagcttgggaacgtagaacaacttcagtaacaccatcattagcaagtagtggaactgcggttaggtcatcgattagtagacggccttcttcgatttcagtacttggaacgccttggaaagattgaatatctttatcaaatacgttagcacgttcaacgaggaaagtaactactgaagcactagcgatatcaacagacccaacacttaggataccgtcagcagcgttggtaaaaccagtaactgcaaatggctcaacgtcgttgccagcgatttcggaagtagcgatgataactgcacgttgttgaacaacatcaacgatacgtttaacgttagtttgtgcagcgtaagcagcgttataatcagcttctagagttgctgcttcaaatggagtaccatcgatacggatgatacctttttcgtttagatatgcaacgatttcatcagctacgtcagtgtttaggaaacgttgtagaccagcgaaagaaccaactgcaccagtaacacgcacgttaacattaccaattttactaattgcgatagatgctagggcgtttttgccacagaagtaacctagaattttatcaaaggaataaccattgatacgttcaaaagaagtattagtattagacatattgtagtccccctattatagttgtactggtagagcagcacgaactttaattgcaacagcgtcagccgcagcagcatcaccaacaccatcagtacctagagcaacataagatttggtacggaagaatttagcttgtgcaattgctttagctagttcaacagttggatcaactggaacagagtaagcagcacctgggcgaacttcttgtttgtcaaatacgtcttgacgttcacagatgaaggttagagcaacagaaccagcaccacctgtaacatcagcaccactagtaccaaacgcgattacgttaccaccaacggttttaaagtcagcagggataacaacagcggtgtctagagctagtacggaagtagtaactagtactgcacgttgttgtagtagttgggtaatcatgaattggttgtattgagcattgctgattgcagtttgtagtgcttcatcttgaatttcggaaccgtcagaagtaacagcggtagtaccaacttcaacatctgctggtagatcaacaacgatggttacgaaaccattgttaccaccccagtattcacgagcagtagcagacataccatagttacggttaaaagaattaagactcataaaaatctccttgtcaaattttgtgcaggaacaccctgcttaatattatttatcaaaaaatataaaccacatttaaatttaaggcaatattccctgatctctatgatattatttatcaaatctgggaaagtgattaaagatgtgctataattatcaacgaaaatggagttttttacatgcaacacacgttcaccgagaaaaggattttacgatgaaaaaattatatctacttgttgatactcaaaactgtttccaccgtagtattaacgtttcttctcaaagtattgatatctggaccaaggtaggtcttgcacttcacatcactttgagtggattaaagaaactacaagaaatgttcgacccacaccatgtagttttttgtgcagaaggtaagtcctggcgtaaaaaattcgacgaagattacaaacgcaatcgtgcagtaaaagcggcaggtcgttctaaagaagagaaagaagaaatggaagtaatgtttgaaatgattaacgatttcattgacttcgttgataatcaaactaacagtactttactacgtgctccatcagcagaggccgatgattttatcgctcgttggattcaaactcacccagaagatgatcatatcatcgtcagtactgacaccgacttccgtcaactactagctttcaatgttcgtcagtacaacccagtacaagaaatgatgtatactactactggtgtatttgataagaacaataacccagcagaagataagaaaggtaatccgattgaaacacctaaccctgagttcttgctattccagaagtgcatcaaaggtgatacatcagataacgtattcagtgcttatcctggtgctcgtatgaaaagtacaaagaaagctgttggtattgaagaagcattcaatgatcgccatactcgtggttatgcatggaactcattcatgaatcacaagtggacacgtcatgatggtgttgaagtttctgttaaagatgcatatgctcataatcagatcttagttgacttaactaagcaaccacaggaaatcattgaaatgatggatgatgttattttcaaccgtgaaccaaaaagtactcctatgattggtgtgcattttttacgtttcgcagcgaaatatgatttagttcacgttcaacgttcacctgaagcatacgtgaaactattcaccaaaaaggatatttgatatggcagtactaaaaaaactaactgagtattcttatatagcagaatctgatggttctgaaaagattggaatacttattgaccacagcaaaagccccactgagtatagtggggtggaattcttcactagtgatggtgtactgaaatttgattctataactgaattggaagagttacttggaacaccattcaagtatgaggaagtacaagtcaaagacaccaatactaaatttattggtgactatccagttaacgatactgatagtgtttatgatgtacaagaaggcgagaacggcattagtactttccgtaagagtgaaaaatctaagaaacgcttcttccctggctggtggcttgttaaatcagaaagtggggtatacaatcctcgttgtactatcagtactgatacgtatgacaatcataaagatgatatctatggtccatacaaaacatttatggaactaacgtatcaacagaaaaacttgtaaggagaatggggagtactttaacgagtacttccctttatttgttatgggcaatttaataactttcaataaattaactaattatgatagttcaactatctttgaaagaatgttagaaaattctgataattcgtatgtggcagtagttccaccaagagttggctcttctgaatcaatttgtgcctatgtactgtacaagattttaaattcaagtgaacgtccaagtattgttttatcgacaccagtttcgtttaaaaccaataggcaatcaatgaattattattttgaaagtatgatttcaaatattaataaccatttagattcaaatttgtcaatcatgcatggcacatccagtagtactattaaatgtaaaggtacttttattggtgaaatattatatagagcgttgtcaggtgataacttgcgaggttttggtagaagtgaaattgtaattgatatgtcaacatatatgagggatgagcatttcatatctatgactgatataatgagatatactcataatatgaaagtaataataaattctcgttcattgtcgttctttacattgttggatagattgccacaagtagagtatatcccgtttttcttgcattctagtattgatatttttgaatatcaaacagcaatgctaaatacattaggtatgaataaatttgaacaatactgcctaatgaaagggaaatatgatgatagacaatttagacaactatgaagacgaacaggagtatagtcgaattaagaagcctggtttaaaaatagagtactctgtttttgaacaggatgaacttgcaaaatgtgcggctgacccaatttattttatggagaattacttttacatagtaagtaaaggtggcgaaatactttttaaaccttatgattaccaaaaagaaatggtaagaaacttccaaggttacgaaaacaacataatgctcactgcccgtcagatgcggaaaaacaaccgttgcagcggcattcatcttatggtatgctatgttcaattcaacaaagacaattctattgttgggtaacattttagcaacagctaaagaaatcatggaacgtattcagttcgcatatgaaatgtgtcctgattttattcgtgatggtgttgagaagtacaacgtaacagaagttcgttttgaaaacaaatcaagaatcattgcacgtgcaactacaccatctgctgcccgtggtctttctgtaaacttactttaccttgacgaatttgcattcgtaccagaaggtttccaagcagaattttggtcagcagtatcacctacacttgtatcatctaagggtagatgtataataaccagtactccaaacaccgaatatgaccagtttgctagtatttggaatgagtcacaacgcttcgttgatgaaggtggcaacgagtacgatgaagatggtcctggtataaacgactttaaaggtattatggtacgctggtcttctcaccctgaccgtacagcagagtgggcagcaaaagaagagtacaagattggtacatctcgatttaagcgtgaatataactgtgaattcgttacatatcaagaaactctaattgatggtattaagttaagtgaaattaagaaacgtagtgttcgtgatcctattaaagaaacggatgatgttaaatggtacaaaccaattgagtacggaatgacttatgtagtaggtcttgacccaagcggcggtactggtggtgatgatgctgctattcaggtatatgaattaccaacattacgtcaggttgctgaatggaaaaataacaagtacttgattacagatcaggtaaaacttttaagacgcatactccttcagattgcatatgaaatgcaggagatgggagctaggaatatcgagaacagtttgttctggacattagaaaataacagtataggtgaagcagctattcttgcggtacaaacattgggtatcgaaaacttcccaggtacattgataaatgaaccaagaagaacacgaactggtcgtatccgtaaaggtatgacaacaactaagagtacaaaaaagactgcttgtatccacatgcaaaaactgatggaaacgttccgtatggatgttgccagtcagtatcttcatagacagcttaacgattttatacgtgctggtactgaagatggtgtgtttaaagcaaaaatgggttgcaaagatgacttggttagtgctacacttcttgtcgttcgtatgatagacattatatccaagtttgaagaaaacactgctgaagttattggtgaaactcttgatgaattagatgagtcatattttatgcctctcggatacatgatgagttataaccgataaataatattataaaaaatgaaggagacaccgctatgatgaaaggggttctttgttcagacatttataagattttggcagcaccacaatacgaatatagtattacaatgtttaatgatgatggtgaaggtacgattagtccacaagatgcaaagtggttttatattcgtccagtaaacttcatgattcaagcaccaagtggtgatgacacggtacgtccagaagtatatctatggaaaagtactgatataaaagatgaacaaacattacaagttttaaaacgacttaaaaacgtttcaaaccaatatggttatggcttcactgtatacgactttggatctgggaatttacctaaaaagttttctcatatcgcaatgcgtaatatggaagaaaccaaacaaggtgatttaaccgagagcctttcaggaagtgcaatgcgttcttattacaaactgccacgagctaaaatggttgttgttcataagagtcgtgttgaagaaggggtcaagggttcccgttcacgaaacgtaaaagaaattttcgtggagtccaacggtgaacgtagacgaatgagtactacaaatttacatgctgcaaaagcaatgacccatcatttaaatgagggtggcgagtatggtgataaatttgggtcttatatagaaggttcagcacgtgaccttgaaaatctaaaagcgttgctatcagaacttgaaattggtggtcgaagccattatgcttccaaaactatgcaatacattaatgacttaaaaaataacttaaaactcgctggaactccacgtggatatcacgcccaattagggagacacaaggaactaccgagaattggtaatacatatatagataattttgcgaataagttaggaacgattggctccgatcatgaccacaatagaagttttgctaagtattttctacttgatgagtgtaacaagttagctgattatttaaatactattagacaaaatatcagtactgatgttcctgatcctaaagaaataacacgaagtgcaaaacgtgtatgtttgggttgtgtgccagttgatggtgaattcgaatttggtgatacaccagatgatgaaaacaaagtccttatgtttggtaataaaatcgtggatttaatccaagatggtattattaaggacgcagtacaggggatatgtgagaaaccttacatggaacctgctgatgctaaatttattattgcacttgggaattcacttctaggtaataaacctaagaagcaaattcttcttgaacctgaacttgaatcactaaaggaatgggcaactggtaaaaaaagcgagacagacaataagtaggtgatataatgatgtttgtcagggcaatgagccttgacaaacagagtaaaaaaaccttgggacggttaaaaatcccatgatataatgtaaattgttgatgagtcaatgaagacaaatcaacgttaatagcccgttaaaacttaacaaacaaactaatgacaaggaagcccaatatgcaaactctagctgaaattcgtgcaaaactaaaagctgaacaagaaaaagcagaagcacagaagaatggtacatttacaggtgaacgtaaagccgattctttcctagctttctggaatgtcccttacaatgaaccactaaacctacgttttctaccagatgctgatgagtctaacccattcttctggcgtgaacgtgatatgatcaacctaacgttccaaggtattgttggtatgcacaccgataaagttaccgttcaagtaccatgtaacgaaatgtgggttcctaaatcatgtccaattcttaaagaagtacgtcaatggttccaaagtgcgaatgaaactggaaacgaagaactgaaagcaatggctggtcgttactggaaaaagaaaacctatctaatgcaatgtttcgttgctcctgatagcgtagcagtaaaagacgatattgctccagaaaacccaatccgtcgtattctagctaacaaagatatctttgataaagttaaatctatcctgctaaacccaggcatcaaagaactaccaactcactacattcacggtcgtgactttggtattgttaaaactaagaatggtggtggttacaatagctatgacatgtctcaattctccatgtccgagcgtccactcaatgaagaagaactggcagcgattgaaaagtttggtctatataatctaaatgattttatgccaaaacaaccaactccagaagaactaaaagctatcgaagaaatgttcgaagcatctgttgatggtaaaccttatgaccctgcacgttgggctttcgcttaccgtccagcaggtgtacaaaaaccaacaactggtactattagtgaaaacaaacctgctccacaagctccagtacaacaacctgctcctgcacaaactcctgctccgcaagcaccagtagctactcctactcctgctgctgaaccagtagctgttgcaccagcaccagtagctgaagctccaaaagaacaactttctgcatctgcactagttgctcgtttgaaacaacaaggtaagtaatagtatttgaaaagttaaggggcaacggagtttgccccgttttatttcataaaattcaaggagcgaattatgaaaatgacaagtggttttgcaaacattctaaaaaatagtactggtagcgttaaaaagaatactggtgttagcgtaggctttcatgatcctgatacatggattagtactggtaactttgctttgaactatcgtattagtggttattttgaccgtggtattccactgggtaaagtaacaatgtttgctggtgaatctggttctggtaaatcatttatcgtttctggaaacatcgcccgtgaagcacaacaacaaggtatctttgttgttatgattgattccgagaacgcattggattcagattggctacaagcactaggtgtagacacttcagaagaaaaactactaaaagtaaacatgggtatgattggtgatgttgctaaatttacctatgagttcatcgaagggtatcgtaaagaatacgaaaatactcctaaagaagaacgtcaaaaagtattattcattatcgactcaattggtatgttgaatactgaagttgctaatgaccagatgaaagctggtaacttgaaaggtgatatgggtcacaaacctaaacagcttaaagcttacatcaccaactgcgtaaactcgattggttcacttaacattggtatggtttgtgtaaaccatagttatgaatcccaagatatgttcaaccctgatccaaaagtatctggtggtagtggtttgatttatgcatcttctatggttatcgcaatgggtaaactaaaacttaaagaagatgaagaaggcaacaagacttcagatgtaagtggtattcgttctaaatgtaaagtcatgaagactcgttacaacaaaccatttgaagatgttgagattaaaattccttgggataaaggtatggacccacgcagtggtctactagatatgttcgagaaatatgaacttatcgttaaatctggtaaccgtctaatgtacgttgatattgacactggtgaacagattctaaaatatcgtaaagaatggatgcgtaatgaagattcttgccttgatttagttatgaatcaattcaaacgtcaccctttgattgaagaagtcaaagaagaagaaaaaggtgatgaatcatttggtactgatattggaagtagtgaggaataatgaaaccttggcattggatcatcaaagatgataaatctaaaataatcgacatgattgaacacttcgaaaaagaaactgaagaagctcgtcgtgaagttaaaaagattggcatcattgaaaagattgctcaggagattccaggctggcatgagactcgtctcagtcagcttcaagaactagaagcggtacttgaaatgctagaaattgaaatgcgtcaactacaagcggaaaagtttaaatatttccttgaagcatatcgtcgagcactatcatcttctgactgtaaaaagtatgttgaaggtgataaagaagtttgtgaattatccgaactaataaatgaagtatcatatatccgtaatacgttttccagtattgttaaatccttagagatgaaagcttttcagttaaacaatattgtgagactacgtgctgctggtattgaagatgcacgtttagaataactatccataaggacgcattacgcgtcctttttctatgcgagaataaaatgacaaaattagatgagttcctatcaaacgtatcagtactagacaccgaaacaactggtgtcgaaagtgaagatgatattattgaatttagtatttcatatcctcacgatgcacatgagaatattgatactattgataactacactttgcgttataaaccactaaaagatataccaccagaagcaagtgctgtgcattttatcagtactgaagatgtagcaaactgcattggttataaagatgacttagaaaacattgacgcactaatggggtgtcgtaattattttattggacacaacgttcaatttgaccgccgaatgatggtagataacgaatataaatatcgtaactcagtttcgcagtacttgctcgatgaagataaatggatttgtacccttcgtttagctaagaagatgtttgcagaagacactgaattcaaaaacttaactctaagttatttgtggtataaatttggttgctatcgtgatgtacatcgtgcagtcaatgctcacgcagcaaaagatgacgtgtttatgtgttatcaagttctaatcaaattgattgaagttgcgattgaacgtggacatattgaccctaatggtgacattggtgaacaaatcgtaacattctgtaatacaccaatgcgttataaattcatgccatttggtaaacacaaaggcgaaccaatggaaactgttccattgaactatattgaatggatgattactaacagtgatattcttgatgcaagtaacccaaactgtgataaagatttagtatatacatttgagtacgaatataatactcgaactaattaataaaggtattcatggatgaaaacttgtaagctaaccttactggacgaggttaattgtaaatttgagggactagatccctcaattcgtcagaagatgattcgtgcaacagaatatgtacttccatacgctaagttcacccctgctggtcgtattggtcgttgggatggtaaggtacagtttatgaacttaggtggtagtacttactaccacatgttggataagttgttgccaatcttagatgaagcaaaaattgatattgaacttgaagatcatcgtgtcaattatggattcaattttgaaccaattgatgaagatatttttagtgatgttgtgtttggtgctggacaccacatggaaggtaagtcaatcaagctcagggagcatcaggtgaacgcagttaatgcttgccttgcaaacccacatggtttattattagcagctacaggggctggtaaaacgctcatcacagcggcattatccaagaaggtacaggagtatggacgttctgtgattatcgtacccagtactgatttggtgcagcaaacatatgatgactatgttatgtgtggtctggatactggtgtgttctatggtgcacagaaagactttggtcaccaacacacaatcactacgtggcagtcattcaactctttgtggaagaaaacaaagaaaggtgaaattgaactgaccgaacaagatgttcatgactttattgatggtgtggtttgtgtgattgtcgatgagtgtcaaggtgctggtggtgatgcattagttcaagtactctctaaagttatgaataacgtaccacttcgctggggattaactggtacaatccctaaagaccaagttgtcgctgcgaagattaaatgtaacgttggtgatgtgatatttaaaatcacagctaaagaattacaagataaaaaaatactaagcacatgtaatgtgaactgtattaaacttaaaagtaatttaaagttcgcgtcatatgcagaagaattgaagtacttagttactgaccgtgatagaatggcatatgtagcatcactgataggtgcgttagcagaatctggaaacactttagtactggttgatagacttgaagctggtgaattgctttgtgaatttttgggtattcctaagtcagaatttgttcgtggggaaaccaaaaagaaagaccgtgaatcttcatatggtgaaattcgctgggctgataacaaaatactcattgcaacctatggggtagcaagtactggtatcagtatttctcgtttgtataatgtcgttctaatcgaaccaggaaaaagcttcgttcgtacaatacagtccattggtcgtgggttgcgtcgtgcagaagacaaagaccacgtggaaatctttgatatcagtggtacaaacaaatatagtgcaaaacacttacgtgaacgtttacaatactataaggaagcacaatatcctcatagtatcatagatgttaaggattgggaaaatacagcgggataatcccgctgtacatgatataatgtgtcgtatgacaacaacaaggaagtaaaataaaaatggaattaagatctagtattgcttttatctgtgaccaagaaacgttagatgtaattgatgtattgttgaatgatgatggtattatggatgacatggtatcttcacttgactatatacctgaactagaaactgacgatactaatgtttggagatgtaatattgacactaattcatggattaatatctatgaattgcaaaccagaattgactcgaaagttgaatcattaaaatatgatatcatctatgcaagtactgatactacaacgtttattgatgttgttagtcttagtggtaattttgattcttacttagataccgatgttgataagattcaagaaatgtgtgaaacgtatggtcttgaattctatggtacatccgatgaagatgaagaagattactacgatgaagatgaagattcccagtactaaggagatgagatgaacgtattaaccccagaaaataattcatttgatatggatttagtaactgaacacattccatcagaaatgtattgtgttttagatttgagtccaaacggtgactctgacttttattttcgccacattttgaacactgtatcatttaatagtatcagtgctgatttgcagattggtgaaaaggttatccaagtaccattgggttggcaaatcatgttgggtgatgaagagacgggtatggttgagatgtgtaccattgaaaacattcttaatatgaaagaaccaaaagcttttgtttacaatccaatccgttcgatgtatcctaagttcgaacctgtaaaagtactgcgtgtattcgcactcactactaagtggcagatccctatgctgcctaagaagaacttactatgtgttcctctgcacagtggtgataatccaccttgtgtttactttgcagatgagaacgagaaaattcaagatttgtatctaggagtgtaatagtgttagatttcagtaatattaaagctaagtcagtagacgaaaacgataaaccaacccagcatacattttctattgctgaatttctaaaacatattgaccgtgcagattacaaatactataatgacatgaccgaagatgagcgtaaggaatttacgccttatactgtacttcgttgggtaagttcacttgatgactcacttcaagtaactttccctagtagtaaagtggaaaacgtatttggtaagtggaaagctggtggcaaagaagcactcactgaacttgtcaaagaactcaatagtactggtgttaatgtaacatcagttactaagtactgtcacagtgactatgattggcgtatcaagtttgccgtacaaagtaatgatgatgctaacaagttgattgcagcaatgaccgaatttagtattgctggtggacagattatctcattggttgacagtgacgttgtacgttatcagttgattatgttgaatgatatggttaatgatgggttctgggatatgaaagaacaccctgaacttgtatatcaactactatgttctgttcatgatatgttgggtggtaaggaattgccacgaaactggttaaacttttccaagagttttaagcgtgctaacaatgaattatttgaactcattaaaagtacacagccagattcaatcgcaactcaaatgaacgaagatgaatataaaattgttttgttgcaatataacaaaaaaacattcgagtctttccttgaagacataggtttgcaagagaaagaaatgaaatcaatgatgaaattatttaaagaagaatgtaagaaatatggcaaagaaatcaagtagtcccgtatacaaatgtaagttctgtgataaggaatttaaacgcgaagacacagttaacacacataagtgtgttaaacgtgaccgctacgaagatcgtgatagccgccccatgagggaggcttttcgcatttatatgcaattcatggagttaaaccatttccctttcaagaagggagttgaaccattaatggcttttataaaatcaaagtactttagtgatttttatgattttgcaatttattatttgaacaaccgtgatattttagatattgatggttttgtaaaaagtctaattgtaagaaaccgtcctattatggaatggagtacttataaagcaaaggatgaatggatattagattgtattcgttctgaatctcccaatgctgcggtttcccgtagtgttgttgcgatggtggaatggggtcagaatctgaacttggagtggaataagtttttttccaatgttagttctgcccgtgcaattgcatggattgagagtggtaagatttcaccttggattatctggttagcaccaaaagaaagtactaataagtttttcaagaatctctctaactctgaaatcgagtatatacttaaatacattgatcctagttactttgaggttaaaactataaagtacaaaaaggaatgtgatgaaataaaaagtatgctacgtgaggctggattatgaatggaaaaagtatatataataaaataccagaagggtatgtacctgtgccaaaagcagataaatctaaatctttatcattgcttagacagggttctataactgaaattacacttgatggtaaaacctttcaggtgcacgatcctgttcgtgtagaaaaaattatcagtatggttgaaagacatgaggaaagattctttggtctaagtcaagagttgtcaaagaccaaacaaaagtgtacaatgttagaaaatcaggtaaccaaattatctaacactgtaaacaaattgcaggagcaaatcaaaaatgcaggattcgacaaattctaattcgtaccgtaaagcacgaacagatatcgacattgacttcaaagatagtaagtcagtgattgcacagcttccttgtgtgcgaagtacagaaaaaattacggaggatggtttaatcccccataacagtggtgttcattttgataatataccaattgaccctatcactggtttagccagcatacaatataaagaagccgaacgcttgggatatcaaaaggtagatatcctgtcacaatcggcttaccagtatgttcgtgatagagcacatttaaaagaactaatgaatcaggaacctaattgggatcttctgttagaaccagaaatagttgaacatctttcacagattaaaaaacatgttacattattaaatgtgtggaaacctaaatccattgatgaacttgcaatgtttattgcaatgattcgtcctggaaaaaggcagtgccaaagtatgaatacatggagtgaagttgaatccactatatgggattacagtactattggcacagaccaagcaggaaataagttacgatatttcaaaaagccacatgcttatgcatacagcttaatgattgtagttcaacttaacgctttagttgaacatcttacttcttcttaagagccacattacgacgcttgatgcgtttttgtggcaaatcacttaaagaaactactggaccacaaacgaaattcaccgcaggggtatcgaatctctgtgtgtaaggttcaaatttctccatctcttcttggaagaatagacagactggaattgacctgttgctttgccaccaccaatcatgtgctatacccaacaattcatcttgcattggttcatccatatcatcaaagcagtaaagagtagtatactgtttactttttatcttgataataccaatgaaagttttaccatcacactgaactaccgtgataaatggtggaatagtattatattgattcatatgagttccataaatattagtataaatttatacctattatttatggaaggaaaaactatggctcatcacggcgtgtttatgtacccttataaccaagaagtatcattgggcaattttaatatgccatatagcaatgagaaacttacaatatacagaggtgcaaataacaatttatcattcacagtgcataacgctgatggaaaatatacattactaaaagataacgaatatctaacattcatgatttttgatgctagaaacaatactaaattattcgatgtagttttggataaacaaaaaccatcatggctatcagaaagtggacaagcaagacaaacattaggtaatagtaaaaaagtatattatggatgtattgttcctgctggtgtaattcaggatactagtcctggttcaaaatatagatggagtattactaaagtaacaatggatggttccttgattgaacctacacagtacttatacactggtcttgattatgaagcctctgctgaattgatcatttccgaccaagctgctcctgtgtttgtgccaagtattgaagtatctgttaataaaaacccagcatggactaccatcaaacgcttgtatcatgaaccaatcgctcgtggcgttattggtgaatttgatataatggcaacatctccccttcctgcacaaatgcagtacggattagttgatggtcttagtactattgcaatgtactttgataaattcattggtagaattcaattacaaggatgtttgtgtaataacgtaccaactgataacgaaaactataaatggtttattgttaaattggatggtaaagaatatatcgaaaatgatattgatgaaaatggattccctaaagcgttagatgggattcaagcatttaattttaaaggcaattacatgtggttgcgattggttgtttgtattcatcctaagatcgttccagttccttatgactatgcggcagtaagaaaagtctatgacccactactgtcagttcctaaaattttgattcgcaggtgagacaaaacaagtgtttgtgctataatcatttgtgagaaataacaaggattaaattatgaacgctgtacaaaacatcatggcacaaatcatgaatgacccagtaccaggaattggtatgtggacacatcacaattgtcctgcttgtgtgttccgtggtcattcacgccccgatactaaaaatcgcggcaatcatatgtttaacgcagatggttctgtttcttataactgttttaactgtagtctaaaaactgggtggcaacctggaaaatatatgagcaaagatatggagtctttgctcatttcttttggtgcacaggataaggaaatagaactagctaaattttacattaaagaaatggttgatagtggagactttgccgaacaagaaactactgcatctaaactatatcaacgtgtaactgttcgtgaattaccaccgaactcaaaaacattctgggaatgggcatcgttaccagaagagcaaataccacaagaatttattagtgttctgaatcatgtgaatgagcgaaatccatatctattagatttagaattgtattggagtccagctaaagaacataaaatgtatgaccgatttatcataccatacgttatgaacggtaaaattatcggatatactgctagacacaaacttaaagacccaggaagtacctatcgttttattaatcaggtcagtactaatattctatataattatgatctgttacaagatgaacgaattaaaactatattagtttgtgaaggtccaatggatgcagcactaatgggtggtgtttctgcaaataactttaaattgtcagcagtacaaatagatgtacttaaagctgcacaagaaaaaggtaaaaagattgttatcgtaccagaccgtgataaggatgggttacaaacaatcgaacaagcactagaatatggatttagtgtttctttcccagattttggggcagtacgtgttggaagtactatacgtcacattaaagattttgacgaagcatgtgctagatttggaagattattttgtttacaactgatacatgatagtatagttgacgagcctttctatattaaagcacaaacggataagtggatgtaacacaggatataaatgagggaacataaatgattcaaagcacagtggacgtcaaacagtatgggattaatgcacaacaatacttactatcccaagttttcagtaatccagatttatttgtacgttgtaaaaatattctaaagccagaatattttgataaaacatttcatgaaagtattcagtacgttcatgattatgcagcaaaatatagttcatcccctacactgaaagatatcgaagtgaaaggtggttatcagtatgatcagtatgaagtacaagaacttcataaacaggcagtactggatacctgtagtgagttttgccgtcacaaagctctagctctagcagtagagaaaggtatggaattagtacatcagaaaaaatatggtggcatcgaagaactcattcgtgaagctatgttagtatctgtacagaatgagttgggtcttgatatctttgaaaatccagaagataccattcgttcattgagcactatgcaaggttcattcaagagtggatgggaaacccttgactataaactattcggtggttttggtcgccgtgaacttgaaatctttgcagcagcgtctggtggtggtaaatcagtagtactacagaacttagcagttaactttgctaaggctggtatgaatggtgcatacatttcactagaactagcagaagagttggtagctgttcgtatctatggtatgatgactgaatctaagctaagtaacgttaagaacgaagctgaaaagattggtctacgagttcaaatggaaggcaaggatagtggtatattgcgtattaaacgtttaccagaatccgtaacaaccactgatgatattgaaagttatcttcgtgaattgcaaattaaaatggaagtcaaattagattatgtttgtgtggactaccttgacctattaacatcaaatcgtcttggtcctaatgataaatctaatacatttacaaaagataaatttgtatctgaagaattgcgtgcactagcaaccaaaatggatttgaccgtattcactgcgtcacagtttaaccgtagtggtatggatgaagataagaaaagtcaaagtcagattgctggtggtatttctaaaatctatactgcggataacgttatctacattgaagcacgtaaagaaactggcgaactttggtttgacttccagaaaacacgtaacagtagtgcagttggttcacgtttgcgtatgtcttacgatattgattcacttcgtgttttagaccatgcaacaacaatccaacaactagaaactgatgggtcaggattccgtcacagtggtgtctctaaggttggtggtggtaatatggcaatgccaccaagtacgatgcaaacattgcgtcatacgctgtctggtgctcctaaaccaagcactacatcaagtgttgaaagcgtaacactaaatacagatagtgatccaatcacttctacacaaactgaatcccagcctcaacagcctcacattggtactgatcgtgtaaatgcaatgaagcaatggttaaatcaaaggaaataatgaatgtctagtaaatccaataaaaagaatctacttgatagtatagttgactatacaccagagaaagatacgttacagagttttggtaatcgtgcagatcatgcaatcaactctgttattcatttattggagagtatcgaagatgaatttaaccaaactgatgctgaagatttgaagaaacgtttatttcttagtattaagaaccgagattataaaaagtttcagaagggcttggagaacatagcacttgatgaaaaacgtaataaagggaattgatatgaagaagaaaactaaactaaaagaaaatgcttctgctggtgcaacatcagcaggtgcagtagcatcagtcagtactggattaaattacccattacttcgaagaatgcctcctacaaatttctttggatataaagttgttgagactaaaaataaggataaggaatgaaaccatatactttctacacaattaatactgttgtagatataggtgatggtacaactccaacaatcatcgattctaagttcactggtgctatgaatttgtcgagattgttggaggctattatggtacatgattatcccatgatggtaagtgtagtaaaaactgaaatagacctatataaagataacaacgcatctttctataatcttccagtttcatggggtaaatgtactcttagtactttcaaattcgcaataccaatggatgttgatttgcgtttgaatggaataccattagttttacctacagaattaaatggtaaaagaattacaaaatttatcacaacaggtaatgatacaaatattagcatcagcaaacagaccttttcttaattgtgataaatatcataaagcaagacagaggtcttttttattttatatggagtaattatggatataaaccaaacagcagcggagctacagaagtttgctgacgcacataatttgaatgttgatgtttctgttgtactggataatatggatgcgggtgatttcatcacactaaatgccgctatggataattcagataaccgtgaaatttttcaaattctacaaaagtacaaagcacaaatgagtgaaagtttctcatacttcagtactgacaatgtaactaaacatattgttgaaagttctgattggcataagacagttgattctatgacaatgaaagacttagttgaagcatacaaaagtaacttcacatactctgatgtttctaagttgagtattcaagaattaaaaactattgtgtttgaagatttatcctctaatttggaaaatccagaaaatcaattaaaatctacacagattgctaaaatgaatgtgtcacagcaacaacagcaagtgaacccacaaacccaagcaaaacttaaacaagcagaactacaacgtaatgctaataacattaaagttagtgttcctggtagtcaaagcggtactgattcaattgaaccagttgttggtattgatgctggacaaaatccacaacaatcattagtagtaaccaaaagtggcactaagccaaacgaattgaatgttttccctttggatgatgtaactccagttgacaatcaaaatcaaagtactacaattcgtgaagagaaatcaccacaagaaattaatagtgaagttatgggtgagcctggtatggaaccagacggtaatccaaattcaccatctccactaacacaacacgcaccaggtatgggtgaaatgattcatgcaatcgctgatatcgaaaaagaagatgatatctatggtgatgaaagtgtaatggcaaactctgcacaacaagagaatgatgagatggtagatcaaatcattgatttctgtcaccgtatgcgaggccgataatgagaactgtacctaatgttcatggtcacaacactatggtttccaacgaagaatacagactattacagaaaattaaggcacgaggttccgtgccagttgaaaaagtaaacgaatactatcaggaactagcggataaaatggtatctcgtggagtcctaaatattgttgagaaagatgacggtactgaagagtattcaactgttaggagtaataaatgaattacgagtacgatcaacaatcagttaatcagatggctgatttgttaagcggtttgaatgacattgaagctggtgcaacccataatgcgtctggtgttccttacaagtcaggtggtgatatcggtgcaatgaccgacatattgacatcattaaatgaagctggtatgaattatggtgttgatccagaacagacacatccacatgttgttccattccacgccccatacaatgaacacatgcttggtcaccaaccagcacaacctgttgtacaacgtgcacctgctaaacctaaaactaactggagtttagtagaagaaaaaattcaaggtactaaatcaacaaaagtatacagtgttaaatgtaatcatagttctcaagttatcatgaataatattatgatgtatgaagctgcactaacactagtaaaccttctcaacgaaggaagaatgttgacagatgcaaaagttcttggtatcatcagttccggtttacaatacaccaatgtaattaccgaagcattgaaggctgcacagaaacgtcaacgtgttctgaatgagtcgaagtacgatgaagcaaaagatttagatatcatcatcgctgaaaagaaagctgaagcatacaaactcaaagagcgtgtactgaactttctaaagagtgaaggttatataaagtaaataaatttagtgatattttataaggaaattcaaatgtctaactacaaaaaactaatggaatctgcttcacgtgttgaagcaatgaagttcatcaaattgaacgaatctaatattgagaaagctgaaatcgttctctctgttaaaggtgaaatcgttgacaaactacaacgtcagtctgaagtaatcaataacatgggcgttgacgttctaggaccactacttgaccgtatcaaagcggaacaaggtcttgatgctgcacagaactttagtgatagcgttcgccacctacttcaacatgcagttactactctaatggatgttaaagacaaaatcagtactgaaactttaaaactaactggtgatatcactgatggtccagcagtttctgatattggtagtgaagatgttgatatcgacattgctgctgacaccccaacgttcgacatgggtgctgatgctgatttcgaagaagatattatttctgagccagtaccaactgagcgtgaaatgaaagaatctgtaaaaccaactcaaattggtattaagatggaaagtgttcgcggtactgtaggtactaaattcttcaaaaacaaagaagaaatgaaaacttggctatctgagaacgagaagaaagttaaacgtgtactaggatacgttaaaaaataattaaggatgaatctaaatgagatttcaagatcttacagaagaggctcctggtaaagacatacgcaatatgattactactattgcgttgtctttagtatcatcgggtcgcgaagaagtgaacctacaatctttaatcgctgaaatcaaaaagcgaaccaacattgatgttccttataatgttatgatggatattctaaactctttgccatttgtgcaagatgcgaattcggatgttgtaacatttactggtaatgattcagaaagtactggtgaagttgaacagaactctgaagaccaagttgaagattgggcaacaaaagctgctgttgcagcaaataagcaataaaaactgagacaaacaaaaatacgatgctataattaggagtacacggatgtacacaccaccaattgttagcagatatacatacgttgattacaaaagaattgaaggcggccccgaaggtcgcctttattcaactccaacagggaatctgccgtcagtaacaacaattcttagtgccacctctgacaatgaggggttgaaaaaatggagagaatttgttggtgaagagaaagctaatgagattacattagaagcatgtactgttggtacttttatgcacgagaacttagaatatcgtctggatggaaagccagatcaccaaggtggtatgccgatacgagttctggcccgtagaatggctgacaaaattcaagaagaagcatggcctagaattaatgaagtgtggggtcaggaagttccattattctatgaaggattatgggctggaacaactgacttagttggagttcatgatggtattccttctatcatggactataagaattcccgtaaattaaagacatgggaacatatcgaaaattaccgtatgcaaatcgctgcatatgcactatcgcataatcaaatgtttggaacaaatattgagcgtggtgtaattttcatctgtgtaagaaaagatcctaacaatttacaatatcaagaattcgttattgaaggacaagacttcaaagatgcggttgatatgtggattggtagagttgaacaatactatattttacgtggagaaattgaatcaaatggaacagcataaacaaatgaaacaagacctatatacaattcgtgcactagaaagtaaaggctactccttagatgaagtaatcaaactaagtgatgaagaaattgacaaactacaactttcaaataaacttctagttaatattaaagattataaatctcgcggtgcaaaacctgtagaagtaatcaaagagaaaattgctgaagatattagtgttgacgaagtatctcgtaatgttgcaccagaagtaatcgaatcatatgtagtagatactgaagaacaaattaaagtatctgaagaagtacaagtaatcgctgaagaactagcacctgttgttgaagaagaagacgttgttgttattgaacgtgttgaagcttcaaaagaagatttggatattatcaaagaagcactaaaaaccaaagaactaaaaagtgttgcaaactatgtaaaacacttgaaatccctagttcctgaatcaattctttcttccgttgatagctctgttgtatctcaactaatcaatgagcgtattgctgaagttaaagaaaacgctaaataatcctataatactataggagatagtttttatggcacaacaacaaattgcgttacagcaagtaagaactggtaagcaacgtgacttaccagacgcgttggaaaaaggccagataggattcagtactgatgtgggtcgtgtattcatcggcctaccttcctcatcagacccagcaagcttagttgctgggcgtacatgggaaactgatccaaactctggtaaagagaacgtggaaataattaccgaattctcaccgtggagaacggtatccaaaatcatcaaccgtccatttgaagtagacattccacaaaaccaagagagtgttgaagttattattgaaagtgaaagtcgtgtattcatcgactacatcgcgtataatagcaatgagactattttagaatcaggcacagtgcaaattgttgctgctggttcttcaactatgattgcacagtcaaataacacaagccgtactgatgcaattttatctattctgtttagtaatccagtttatgattcaagtactggaaatatgcaatttgacatagttaatgcggattatttaaattcaggataccacatagaatttgtatatcgtgggtgggacaaaccttaaaaggcgtcccgcctttttcttccacaaaatttaagaactgtataaacaatataacaaggatgacacatgattaacgtaaccaagcgtaatggaaaaaaagaaccgttatctttggataagatccatcaaattttattttttgctgccgaagggctgagtggtgtatctgtttccgaaattgaaattcgtgcacaacttcaattctttgaaggtattgaaaccaatactattcatgatattctgattaaatcagcagcagaacttatttctgaagatacaccaaactaccaatacgttgctggtcgcttactaaattatagtatccgtaagcaagtgtatggcgactatgaccctatcaaatacactgcacatctacaagaaatggtagatacaaaaatctatgatccagaaattcttgagaaatacacacttcaagaaattgaagagcttggacgttacatcaaacataaacgtgatgataaattcacttatgttgctatgcgtcagtgggaaggaaagtatctatataagaatcgcgtaactaagaaaatatacgaaactccacaaatggcatatatgaccattgcagcaatcatctttatggagtatgatcgctctgtacgtatgtcttatgttaagaagttttatgatgctgttagtaactttgatatcagtctcccgactcctatcatggctggtctacgtaccaatacacgtcagtttagttcttgtgtagtactaaacgttggagatagtctagatagtattggttcttctaaccacgctatactacgttatatttcccgtaaagctggacttggtatcaatatgggccgcattcgtgctctggactccgagattcgttcaggtgatgcagtacacactggtttgattcctttcattgcatcaactgctaagaccgttaaaagttgctctcaaggtggtgtgcgtggtggtgcagcaaccgtccacttcccattgtggcatttggaatttgacaatcttgtagtactgaaaaataacaaaggtactgagttcaaccgtgttcgacaacttgactattgtttccaagtgaacaaaacactatatcaacgtttagttgatggcaagaatattacattctttagtcctaatgaagttcctgggctatatgaagcattctgttctaaccaaaaagaatttgaaaagctgtacaagaagtatgaagctgatccaagcattcgtaaaaaatctgtatctgctgttgaagtattcagtactctaatgactgagcgtgcagaaactggtcgtatctatattcaaaatattgaccatgcaaacacacactcaacctttattgaatcaattgcaccaattgaacaatccaacttgtgtcaagaaatcgcactaccatctgtgccatttgatgatattaatactggtgaaggtttgattagtctatgtactttgagtgcaatcaactggggtaactttgatcgcccagaagatatggaaactgcttgtgatctttctgtacgtgctcttgattctctattggattatcaagactacccagtagttcatgcagatcgtgcaacaaaaatgtaccgcccattaggtgttggtatcattaactttgcatacttccttgctaaacgtggtttacgttataatgaagcagcattagaaacagttaacgagtgggctgaagcatggtcttattatctaattaaatcttctgtacagcttgctaaagagaaaggtaagtgtgaaggttttgacacactaaaatatgctaaaggtattctaccaattgatacctataaagaagatattgatgcgttggtatctcctgaactaaaacaagattgggaaacattgcgtcaggatatcaaacaatatggtattcgtaacgcaacaactatggcactgatgccagcagaaactagtgcacaaatcagtaacagtactaatggtattgagaaacctcgttcacttgtaactaagaaactatctaaagatggtattctgaaacaagtagttcctgaaatcagtaagttgaaaaacaaatatgatttattgtgggaccagaaagataacatcggttatctacaaatctgtggtgttcttcagaaatacattgaccaaagtatcagtgtgaataccagttacaatccagcacacttccctgatggtaagttgccaatgtcaacactactaactgaattaatgtatgcatacaaagttggtttgaaaaatctgtactatcataatactaatgatggttctgatgaagttgatgttgagaaagtactaaaagaagctgcaaaaccagaatcaggacagtttgtgttgcctacactacctgacttagatgaaggtgattgtgatagttgtaagatctaattaaagatcccgcttcggcgggattaatctttccaaatataaaggaatatatatgtcagttttcaaaattaatgagaagtctcacctagaaaagaatatgttttttgatgaaagtgttgatattcaacgctttgaaagtaacaaatactctgcacttgaaaaactaactgaacaacagaaaagtttcttctggacaccaggtgaagttgacgtatctaaagataaaattgattttgctaacctcaatgattctgagaagcatatctttacatcaaacttaaaacgtcaaatccttcttgattcagttcaaggtcgtggtcctaatctaatgctactaccatatgcatctctacctgaacttgaaaattttattgaaacatgggctttctttgaaggtgctattcatagtaaatcatatacacatattattcgtaacatttatcctaatccatctgaagtttttgatactatgttggacattccagaaatcactgattgtgctgctgatgtttcaaaatactatgatgaccttgatgaactaggaacattgtatcgtgcattaggtgaaggcactcatactgttaatggtaaaactattgaaattaatatgtatgatctaaagaaaaaactatggttatgtttgaatagtattaacattcttgaaggtgttcgtttttatgctagttttgcttgttcatgggcatttgcagagaacaacctcatggaaggtaatgcaaagattattcgtctaatttgtcgtgatgaaaaccttcatctcgcagcaacacaaatgattttacgtcttctaaagaaagaagatccagatatggtaaaaattgccgaagagtgctatgatgaagtactggaaatgtttatgtctgctattcgccaagaagaagcatgggcagatttcctctttaaagatggttctattattggattgaactctgaaattcttaaacagtatgttcgctggattggttctaagcgtatgactgcacttggtatcaaatgtccatatactgtatccaagagtaacccactaccgtggactgaacactgggtaagtggtagttctgtacaggtagcaccacaagaaactgaaatcagttcttatatcattggtggtattgtgaatgatatccaaggagatacattctcgccatttaaactataaaataaaactaacagggattctatgaatcccttttcttatggaatttatatgagtgatatttttacaattgagcgtaatgttatctatgacttctacctaactggtggatttaaggtaactggtgcagtatctgatgtttgtcccaatggccttgtacttgtagatggtactagagtcgttcaggcacacattgtcatgtttgtaccaaccgaataaaatttaggacaaacaccagaactgtgctataatgagttttgttaaacaaaaggagatataaaatgaacgttaacaatctaaatgaaatggtagaaaagaatatcgacgctgcggaagaagttactggatacgaattaactcctgaagacctagagttatcgaagaaaatcattgaacaactttctgggtattatgtacgtaaagaccagaaaattaaagaacataaaaaagcaaaagctaaaaaccgtgctcgtagcaaaatggctaacaagtctaaaaaagcaaaccgcaaataaatgaggtattgatgatgcagtatatattgtctaaaattaatgagaattttcctaagtcgaacgtgaaaagaaccaaccgaacacttaaaaaaatgcatttggatgaatatgctgtgtcgttggcttcaatcactattccagtatatctatttggtctagaacaaactcaaactgaccgctgccttgatgtgatttatgaacacgatgttgggtgcttcgtgtgtggtagtgatgatggcttcactatactacatgaatttgattcattggcagatgataccagtactgaagaatatattaaaaacttcactgaaaaccttattcgcgaattatcaaatattgaaatggaattcgcaactacacaaacagtcactatccaatacggtgacgcatattatggagaatggtaatggcaactacactagaacagtataaacaagtaactgaatttatggaagtgtgtaatcaagaagtaaatactacccgtaaattccaaactgcaaaagttgcaaaccttcgtgtgaatctaatccatgaagaaatctttggaactggtgaattagttgaatcagtaaattacgataataaaacaggcattttagatgcattgtgtgatattctgtacgttacttatggtgcaatcgcaacgtatggttgtgtagatgcactaagtgattatgaagtatccatcggtctaccagaagaacgtgaaggaattttactattcaaacatgcttcctcatcttatattcgtgaaatctcaaactactttgagcagttcaaacgtggtgttgagagtggtgatagccgaactattagtgatggtctagttcgcattgtcgcttcatgtgttgaatttgcacgagttagtaatttcgatctatccggtgcatttaatgaagtacatgaaagtaacatgagtaagttctgtgcaacggtagaagaagctgaagaaagtattgctttccgtttagcagaagctgaagcacttgaaaataaagtgaagggtctagaacaaacacgtaactacactgatgcttatgtggagaagagtggtagtgtttatgtaatcaaacgtaagattgatggtaagggtctgaaaggtaaagacttctttgagccagatttggctaagtatgcataattaaaaaaaagaaagggagcaacacaagtttgctcccttttattcatttaatgttttgtattgaatcatcaaagttcttcatatatggtcgaatattgttaattaggttctgaacttcatgctgattaaatgttctattggttgtaatcataacatacccagcaacttcaaactttttcttatctaggataggaatagttattattgtgttataagtataacgaatgtgtttaacatcatcgcatgaataatctttggtattatcatagaataaactacattctagttttgaaccaatgattgtttcataatgaactttattaagaaatatttcttgatatgctctatcgcttctgtctaaagtgtacatatcagtacgcattcttcgtacaccagagcgatctctaagtgctagtccgaacttggcctttatacattttagtgtcttcatctggtacaaatttgtatagaaccaccgtactaatatctgaattctttgatagaatttctataaaagactcatttaccttatccagttcaaaagaacttttgaaaaaatatttttcaatactgggtattaccgttttggtaattctattttctatctgtgacctattaagaaagagaaaaatactcaaagtgatacaagaacatacaattaacactcttagaattgaactacaaattcttttatgtgttgacatgtgtttcctcttttatttaaaatgagatataatatcctacttcattaactactttcgttgccatttgttgaaacttttcagcttcttcggcattttttggtacacgtttgaaataaacactaacatatccctcgattgaagtgtacttgattggtacagaaacaagataaacaccaccgtcttgaactattgctgggaagttaatcggtgatagatattcatttcgtgcttcattttcaggatttaaatattctgtgtaaattttagaaatctcaacacaaaatattttcccccttagtaatgtatttgtttcagcactaaaagcactaattggtagccaatctaaattgtatggtttaatattgatacccatagatgcattagtttcatctgtgacaagtactctaccttgatagaatgtgttgttatctggaacaaacttataaaccaaaaccattgcaatatcttcagagtttgcagaaacgtacttgtaaagacttttatcaatactttctaatttctctggagaaattgtgtatttgtgtggtttaaacgattcatattgttctgggttgtttagtttgttgtttatgtaagtttcccatgaactggatgttatatatactacaaaccccaagacaagacacagcgttactactattgttctaataacaggcattccgggagataacttcaaggattttgttaattatactactatctaagtcgatattcatatacccgttaatctccaatcttattgttatttttataaagtatttacccaaatttacgtttttgatagtttatatggagttaaagtaataaatgcttattttacaagttatgtggattgatattatattaatctttgtatgtgcagggtatagcactacagctagtatattatactgcatatcgttgatttttcttgcttttatggtaatgttccataaggagataatttgtgtttacaaactaaaagataaatcattgataaacaattttgaatcaattgctcatatctatccaattggtagacgtactgttataaacataattatgtcatctgttattaacggtttcatagcactagtggcattgaactcacttgcaatcaccattgggattgtggtattatgcgtatatcgcatttataatgaagaacaactggagaaattagtatgtcaaagatgattctatgcactgacgaaaactttggtattggatgtaacaactcgatcccgtggcacagttcagcagactttgctcatttcaaagaagaaacaaagggacgcatgataatcatgggatataatacttggaagtctctaccaaaaaaaccacttccaggtcgtatgaatatcattctaatctcacgtgaatgttatgacattgaacagtatgcagatgatactagtgtgatgtttttacctgaacgctgtttacctgaattgcttcaattcaaccctgaaagtatcgttatcggtggtgctaagatttataaagctgcacttccttatgtacaagaagtgattcacagtactgtaaaaggtacatacaaatgtgatacgttcgttcgattcaaagatgacaagcgtgtaaaactatctcgatatgaagccaaaacattgtcggatggaacactggttgattattatgaagtcgttcgtgtttacgatgagtggatggatgcatatcaatgaaaatagacttatatactgatggctcatgtcttggaaaccctggaccaggtggtgtgggtattgttgttattgttgataacgaagtccaggacaaactatcatttggtgatataatgactacgaataacaagatggagctacaagctaccatcgctggtattcaatatgttaaagatgtgtacgataatccagatattactgttttcactgattccaactacgttgtccgtgggatgaacgaatggattgttggatggaaaaagaaaaagtggaataacgttaagaacgttgaattatggcaaattttggatagtatcagttcaggttgtaaatttgaatgggttaaggcccatgcggataatgtatataataaccttgctgatgaattggcacgtgccgctgctgaggaaatcaagaagcagtcaacttaaagtgtaataatcagtcgagggaacgatgagtaaaatcaagcttacggataagcaacaagaaatttttgataattttgtagatcgtgtttataattatgcaggtaaaactatatctgtactgtcagcaccagcgggtacaggtaaaacattcactactgctgagattgttaaagcactatgtaaaaattacaatattgcagtaacatcgccaacacacaaggcaaactctgttattcgcaatatgctaatcaacaatgctgggttaactaaagaagatgcacaggttagtactattcactcatttctaggtttaaaactagtatatgaaaagaatcgtcaagtactgaagcatgacccacaaagtaaagttagtaatactaatgttgatattctaattgtcgatgaatgtagtatgatttcagaagaactgtttcaacacattcaggatcaattgtggcgtgttcgccgagcggttttattcatcggtgatcgctgtcagttgccgccagttgaatcagaaggcacaataggagaaactaagctttcccctacttttgatgttccagtacaatatgaattaacagaagttttacgtcaagcgttggataaccctatacttgcaattgcaactgcaatccgcgagtgtataggtacttccaagaacccgtttgatattatgcaccagacacatggtctgagtactattacaccaattgaagatgaagatcttttcttggaagtttaccgtgaattcattatggagaacaaaggttcagctaagaagatatttgattttgttaatgaaaataaaatcttggcatacaccaactaccgtgtgaacttggctaacatctacattcgtagccaattgtttgaagtaccagaggaattcacaaaaggtgaaccgattgtctttgaaagcatcactgagaacagtccatatgtggttcagcaaatcatccaatgtcctgatgtgaaaaccgaaagtttcatgggtattgattgttggcaattccgtttaccaaatggtagctacatcttaggtgtaggaccagaaacgagagttgcaatggaagctaaactcgatgaactagttaaaaacattgagaaaaaagaaatcaacccattgacaaagaaaccatatatgtggcaagattactatgtgattaaaaacaaattacatattatcaactatccttatgcaacaactgttcacaaatcacaaggaagtacattcgataacatctggtttgatactgattttattgagcgtatcggaactaacgatacaaaatgtagaatcctatacactgctatgacacgaccgcgttacaatgttatgttgcgtcagaatgcacgattctaatagactaaatgatatacataaataattttgattcttaacaataaataatcaaaagtgttttgtattatggagaagaatatacaatgaacaatttactacaagtattcaaaattgaagttgcagggacaaatctagataatattccttattatatgtatgaagattatgattcatcttccccaacaactgcaccaaccgaccaacaaacaattgacaagtctgtagcactactacgttacctacaggttacacgtctactatcaacttattctgtcccagtgtattgtactgttgaatttgctaccccaggcacagcagcaactattccaactggtgcaaccatcaatgtgggttatatcagctacgagccattcctaagcactctaagtgttgaagaacaagctgcactaatcactgttgatcttaaaactgctaaagcagcagaagttattcaagaattgttaaacgaatcacttaaaggtgatggtactaacgcaattgagaatgaagaaatttctgtacagaaaacaatccaacgtgttaaagatgcactatctactaccactgttgatttcattgagtacgagaatgtgtacttaaacgtaccttctgtaactgatgctgctgtagtttcttacgtaaaattataatttaaccacatggagttcttgacatgactgacaaaaccttttatgatcgtattattgaagacaagggtgttttcgataaagtagtttatgacttagaacttatgatcaaagacgcaccaaatccacgtgtgcgtactcaagcagagtttgctaaaacttatctagtgcaagttcaagcaatctgtgaagcaattaaaaaacataatgatagtgcttgacagaacattagttcttagctataattactatcgaattgaacattaaaaccatatcggagcttttattacatgaaatctattattgccaataacgaaatcaccgcaaaaactgtccgtctagttacggaaggtaaaagtgaagtcatggcaatctctaaagcacttgctttagcagaaactgaaggtctggatttggtggttattggagcaggtgatgaacctgctgttaaaatcactgatctgaacaaattcaaatacgaattgaaacaggctgaaaaagcctctttgaagaaacagcgtcaaaacactgttagtactaaagagattcaattcaacttcggaactcaagagcatgatttgcttattaaagcgaaaagtgcaggtaagttcttagaagaaggtaagcaagtacacattgtaatgaaaaccacaggtcgcggcacaaacgcaactgttatccaaaacaacgttgatgcaatggaatcattcgttcgtcgtttgggtaacgtaacgtatgtccagaaagttgaattccagggtaagaaggtaacctgtactgtcaaagtaaaataataaggacgattctatgaaacatactatcgaacaacaagtgttttcacttcaacagttcagcgttgtgaaagctacatataaagattcagtttactacttagcggggagttataatattactccttatgtaactaaactacaatccgaacatagtaaagttgacaataaagtacttaatgctggactagaactatttctaaaagaacatccagaaaaaaatcttttggctgttcctaagttttactttattttgttagatgacccaaccacctccgctgaatttgttgaatgtgtatgtagtgaagtttttcatcttagctacaatgaaacgatggatgttattgatgcattaaactcatcatcacattcgtacaatatgggtacattcacagatgaaatgtgtattacattttcagctatgattgacaatggcaatgaacaattgcgtcaaaatcttaaatatgacaaaatcccagtacagggtaatggaaaagattatgacgcagcactggaagcactagaaactctaattcgtggtgactatccagacgatatttaacagtatataacctaaaaaactccaagattagatatctgataaatatctaaaacaaatcttggagtttttttattatgaattatgaagaattatataaagcaataatggaagcaatcgctcctaccgatgtagagtcttctcacttaaaaactattgaacacaatggtaaagacttgtacattacttttaagaatggaagtacttatgaatatgatgatgtaccagaatcattagttcgccatatgttaactgtagattcaaaaggtcgttttttgtggagatatatccgtgataaatttccgtaccgtaaaacagcatctatttctaaaaaaacatatgcttccaacccaaatgccattaaacagcgtttacgttatgatgttgatacaggtgaatgggaagatgcattaacccctgatgttattaaaactgttgatattccggttggttatgaattccgtgcacctaacaatcaagattatgtgtttcagggaaaacaatggagaagtaaacaaacaggtaagattgcacctaagcaaattggttctaaaataactgatattgctaaaagattgataaaattaaaagggaacgatcaggaagggacagatgaaatataatcaattacaggagtctatcattaaagtccccagtactactatgacacagattaacagttatgtggcaagtgttctgtactttaaaataaaacaatttattcagcaatatgatattcatgtagatgctgaaacacgtcagcatcctgccgccgaaaaaataaaagcgaatgttattgctgagtgcaaaaaaacactaaatgtattgagttcaaagtatggagctaaaaatattagttcacaatcattcaatacaattgcaaaccagtcagttaaaataccatttgatgctgaacaatatattaaagaactaaactttaaaaagttagctccagaaattgttgatgaaattaaaaagacaaaactatcattagttattgcaaatgattcttctgctaaagaacgtggctccatgactgaaattgcagataatgcttatgttattagaataaacattagattagcaccgaaagaaatatattcatcttctatgcaaataatgagtactgcataccacgaagcacaacactttgtgcaaagttcagtaatcaagaagatcaatagtaaatcaaaccaattacaggttaagaaaaactatggcaaagaccatgatgaatacttaagttctggtattgaatatactccacaacttggtaatgtgattgatgcaatgcaaagtgaagcacaactgctgattgatgataataatttaccacaagacccaaaagaagcatttaataaagtacttcaacttgtgctatcccgtgatgataagtataatgctcgtggatttattattagtatctataaaaattcacaaaagaaataccgtactgttatgagtactttatataaaaaattcatggatgcatttgaaaacattaatgctaatagttctgaacatgaagaaggtccagaagaagacttaggtgtttctgtcaacgaaatgaaaacactaagcgatgtggctgaaaattctagttatcttgaaacccgtttgtatggacattcaagagatgaaattactaaaattcactcacaaagtattgaaaacggttgggagatgatagttactaaaccatccgaaaatagtgatgcaattattattcaaataagaagtgattctgaaaatgaacgcaataagatgaattacaaacaggctcaaaactttgtaggttcagttgcgaacatggatttcactgttgatgaagttgtagaattccttgatgaaattttacatatggatgcagatgaagcgaaagctgttaatggtattgtgagtaaggcagagcaatgggctggtatgattggtctaaacttcgagaaaacaaatgaaggatttaaattaaacgatactgaatttgtgattgagccttatagtggtcgtatggtaatatcgtcaccacaactaccaaatatgtatctagttggttcagataaaattatcaccgacatattgaaatacattctacgtttcatgaaagagcagccagaaaaattactaaaaacattgaatcaagatatctcaattgttaagatgagaagagagttagggagtttataatgccaagtaaaagtaaaagccaagcgaaattcttcgctgctgctgcccataatcctgaattcgccaaaaaagcagggatttcacaaagtgcagctaaagagtggaatgccgccgacgaaaaagcgggaaatcttaagaaaggttcaaaactccctaataaggtaaaagaatctagtatgcgtggtttggttgatattgtacaagatgcagaattagctgatacagaagacagaactagtgatataatggattcatgtgaagaagaacataaagagaaattggaagaaatgccacaacgtttcgatagtttccaaggccaagaccgtgatgagttcgttgataaaactgccgagatgacaggtaagcacaacatggtcaagttcgcagaacacaaagattatgatgtgtttatgaataagaatggtactgggtttattgcatatgataaggctggtaaacagcttgctatcgttagtggacatttgtctaatgatgcggtggtaggtgtaccacaagtgtttgagattgctgctacggcctccaaaactggtactaaaggtatcatctataatatctttatggatatggttgctcatggtattaaagtactaagcgacagtcttcacactgatgatgcaattaaattctggacccgtttgattggttcacaccaagtctacattgttggtggtggtgaagtactggctaaggctagtccagagaaggttcacaagtactggagtgatgatgaatttagtcctagtgctgaattacaattacttctggtaaaataataattgtcggggcatttaatgtcccgatatttttttgagacaaacaaagcattgatgatacaatgttgcatgacaaagagacattaaaaaggaattcaaatggctaagaaagaaagtgctgttcttcaggaacatgatgtacaacgtctaaacgattatcaacatgctcgcttgcgtactgagatgtatctgggttcacgttctgttcacgaaagtcaagtactgatctttggtgagtctggatatgaagttaaaaacgttgagtgggttcctgcaattctaactgctactcgtgaaattatcgataacagcttagatgaatttaaaaaagctggtacaaaagagccagtactcaaagttgatttcaatgaagaagagttatcctttgagatcagtgataatggtcgtggtattccaattgactatgttcctgagtatcagaaaaacctttgtacaatggtaatgactgaaactaaaactggtcgtaactttgatgattcgaagcgtgatgaaacaatcggtcagaatggtttgggtggttcagttgcaatgattgtaagttctaaagctgaacttgaaatccatcgccaaggtcgcccgtataaaacacaaagtagcaatgacggatatgacggtttttataagttcaatcagaagttcgaagaaggaactattatgtttcctgaacttcatgtacatgaaccaactattcgtaaggttcaagcagataagactggaacaacaattcgcttcactctgagttctgaggtatttcctaaccgtaaactgccaaccgaattgttatacagtattttgaaagaaatgtctgctgctaaccctacctataagattttccttaacggtaagcgtattgcaattaaaggaactactgaaaaagcactattcaacgcatctaaactgatgcaattgaacgttaaagatgaatcattcaactttaacagtactttctacattgttcctaatgcagtatcgggtatgaacactaacttccatatgcatggtttggttaacaatgccccagcatttgatggtggtacacatcttgatacattcaagaaattcttctcattaggagtaggtactgctctagagaaagaatcaaagaaacgcaagatgaaacctaaccgctctgatattgaagaaggtctgttgatttataacgtaacaacgatgaaagcaccatcattcaactcacagattaaatcaaaactaactaacgaaaacgttattcgtccaattcaacaagcgatgaattctgaatggttcgatgaattagtcaagaagaacaaagagtggattgatgaaatttttgaacgctgtgctgctcgtaccaacaagaaagatgcagaagaagatcgccgtctagctaaaaaactattgaaaggtaaagttgcaaaactacttgacagtactggcacagatcgttccacctgcatcctactaattgctgagggtgattctgctatttccaacatggcaagtgctcgtgatcctaaagttcatggtattctaccattgcgtggtaagattatgaacgtcagtggtaatgagaaaaccaaagaattaatggattcaatggcattgcatgatataatggcgagtatcaacctgattcctggtgtaaaagcggaaagagcagaccttaactatggtaagctttatatctgtgccgatgaagatgaggatggaaagaacattggtgctttagtatgtaacttcctatacaaattctggcctgaactattccaagacccagagaatccatttgtgtatatattcaaaacaccattcatcattctagagaaaggtaaggaatccaagtactactatggtcatgatgtacatgaatacaacccagatgattggaaaggttggaaagcaacccgtgcgaaaggattgggtacgttagaaaaagcaaacttccgtgatgcattcactaacagtgttgcagtagcgattacagatgatggtcgtcttggtgaaactcttgatttgattttcaacaagaaacgtgctgatgatcgtaagaactggatggaataatatagattaatggggaacatggtgttccccttttacaaagagacaatggaatggctaaaagtaaaaaaaccgaaaatcaaagcatcgataaccaaacactaactctactagattataacagttctgattatgtgaataccacatcactagaatattcaatgtacacattagaccgtgcaatccctgggattgatggccttaagagttcacagcgtaaagcaatctttaccctctcaaaagttagtggtgaaatcaaaactgtatcatgtgctggtaaaatgattagtgatggtatctatctacacggtgatacatctgcatctggaactctccagaacctagcatcaccagtggtaaacaactacccactcattggtaaacgtggtggttttggtacacaagtaaacagtactccagcttctgctcgttatacttatgttaaaaagaataaaagtactgaaatgttagtactgcgtgactctgacattattccaatgaaagagaactatgatggtactacaatggaaccaagtttctttttacctattatcccactatctttgtttggtaacgatagtatgtcagtaggttataagagtacaattctaccacataagattgaagatgttattgataactgtattcgtgctattgataaaaaaccattaaaagaaatgactccatactatgtttcatgtggtgcaagtgatatcgtaactaagcttgatgaaaacaaatatgagttctatggtaaagcacaagtaattgatgccagtactgttaaagtaacaggtctaccacctaactacagtattgagaaattcatcgagaaactcattaagatgagcgatgatggtgatattcgtgattatgataatgatagtactgatgttattgatattacaatcaaattgccacgcggaacatctgctaaatgggtggagaaagatgtaattgaatactttggcattcataagaagatgacacaaatcctaactgttctaggtgagaatggtaaggttaaagtctatgataacacaatggatttgattaaggactttgttgaattccgtttcaaatactatgtgaaacgctatgagaagaaacttgatgattgtgctgctgaagtacgttataagattctaatcaaagaatgttttgataatgatatgattgctaaggttaagggttttgctaaccgttcagaaatggttgagtttgttaaatcattaaacactgaaatcgaagcaacagatgagaatattcaaagcatcgtaaacttcccatcatatcgttggacccaagacaattatcaatcagtactagctgatattcaacataacttggatttaatggatgaatataacaatctcctgtcgaatcatgatttgatttggaacatctataaagatgagttgaaagaactacgtaagattgacttcacgccaaaaactgaagattgattataaacagggaagacctttatgggtcttccttgtcctttatataaataatctatagataatggtagcttggctatggagaattataatgacaacttttacccctagatgggatataaaagccgatgctcgatatatacaagaaggacaagacattcttgtgcgtttgagtatcaacaaagaaaccacaacggatgatagttatatacttaatgaaaacgaatacttagagatgattctaactattcagggtttggacagttctgatgcagtatttcaaccagaagatcactacgcagtgtatgttggaaatgatgaatctaatctcacacctatatcatcaggtattactggtaacaagttgattaatggtaagcacaaatgtaaaattgataaaactcaatttgatctatcggcaagcactaataccgaagatgtttattttattaaattgcattgtaaagatgatggtacatttaacaactctgaacagattaacttttatcttcaagcagtaaatgttatgtactatggtaacatttcccctagtggtgaaattggttcaaatgaagtaacaattgaatatgatagccaggaagtgtgggttactcctggaatcgaaatcggtgatgatgacaaattatattgtattggcgatattgaatacggttccaacagtactttatttgtacagggatttggtcgccgtcgtccatttattttaggaactgatacatcaactgacctatctcctagagtattttatccagcgtatcgtctactcgatatgaccccagcagaagttcctgctcgccacattactgatgattatgcaatcctacgtcctattgataatatatggcctgtatttggtattaataaagaaattaaggttaatattcaaactagctctggggagttactagattcaggattggttttcaacccaaatggacaatttctgcaaacatttctatatgactctgatgcatgtgatgcatatttcaaagttgaaattgttgatattttgagcacatatagttatgacactgaccgcttcgctataaaccaacgtttcaaagcatatcaaatgtgggtatgtccagacaatgtagatggtatatacgctgatggcgataaacctttacctaatcatttgtatcagttgaaagataacgttgtatatccatatgtaatcactggtgaatatgatctaggtgaaacaaagccagtgtttaaaagttcagattggattgatttaggatattatgattcaagcttaggtgagaatattataggtgcagagaagatgttccgtgttctagtgaacgcagaagaagaaaactcaatagacttcacaactgatagtgatttaggtagtattcatgtgggtgaatatttcggtcacagtacttatccacaaatacaaactaccagtcctaatcaggtatcttatgtattagatggtggacctgatgatattcgcaaatatggtttggatctcaccgcagatgggttcttggtcgggacggcatatgcaaaaagtttagatttcagtgcaaatgatgatataaatttagaattcaacatcaaagcatatgacactgaaggtggtgttgcgtccaagttatttaaacttaaaattgtacgtggttttggacaaaactacttaagtgcacatattgtaccttctgtttattttgaacgtgaatggtttaagtgtattagtacaccatcatttacaaatcaagctttccatcgccaatcagatgatagatacgggttacaaaaagtaccacgtattttattaaaagaaaactttttgagtcagaactatacttacactacgttgagtgatattaaaaaagtacttagggaaaatatcataaaccaaactggtgcaactatacctgatggaaaatttagaatggtaatgggcaactataaagtaatgtcagcacttgacaaccaaggtaacttgcagtatgatatattataccgtgaagttttaccagcaggttcattggtgtcagtttctaagaatccaagaagttacacgcaaattgataacggaacactcggtgaaatatttggcttgcgtcaaaatatttttgcagcaattggcgaagacacaactaaccttgtgaaagacccaactgatttacagaaccgtggtttgtatgtagatgctatacctggaatttctgatgagatgctagatactgttcctcgcttcatgaatcacccatacgaagaagatggagttaaaaagaaattcatgccaatcattccagttgcatactgtgcaccaggaaagggtgaagcattctttaacactttacttcagaacaatgaacatggtaagatggttggtgttgagtttgaaatcacaggagttgaatttggattctttgcacatgaattcgaaaactacgttcatgatacatttttgatttcattacaaaacagcaatttaggaggatgatatgttcaatccattttttgatccatcaaccatgaccgagaaagagttacaattgaaaattaacgaacaatcgatgcgtattacgtctgctcgtgcagcaggtatgagtgatatgattgttggtaacatgcaaaccgttctgaatcagtgctatgctgaattagagattcgtcagggacaaaaagaaaaaacctcctatgatgagcaagacccatgcatatttgacatgaactcttacttaacggataacgaagaggatcagaagaagaaaaatgaaagtacaaggaaacagatttataagtcccaatggtgatgtaaaatgtaaccttaatgcagtcgtgtatgcaatcaactgtggtgcagatattcagtacttacagctacaggagattgatgaaccggaacgattgaaatttaacgataattgtaaaaaatttggtttagaacagcgtatgctggattatacaatagaacatgataaaaaccatgaactatggcgttatgatccagtgtacgataacatcaacttgcgtgagtactttttacagaaatgtacatcggatgaagcccgtgaacgtgtaatgtatgagattgatttgtttgaacattacaacatgactaagcttttaagatgtatgatctggttagttgattatatggaagagcacaatattttttggggtcttgggcgtggtagttcagtggcttcgtattgtttgttcctgattgatttgcatatggttgattctttgaagtataaactagatgtaaatgaatttttgaaatggtagaaaaacatgtgatataatgttgtttgaggcgttatatcactcacatagaaaaaggatttttatatgtcaaaacacacaacttatcgtggaaccaccattgatatggatatgctaaagtatcaaaaccagcacaaagtagcactaggtaatgcaaacctaaatgctcgtggtgataagattggttcgggtggtacggtcattaaaacccgtgaagaactaatccaagaaaaagaacgtgaaatgcaaattcctgatttcattcctgaacaccaacttcacagtgctgaatatagtactgaagaagtatgggatgatgaaagctttgaagttcaaccacaagaaccagaagttgaagtatctgaagagaagaaagctccacgccgagcaaaaactaaagatcaggagtaattcatgaccaataaagtaatgacagcttgtaaaggtaaagttattgtaactgaactagaacatggtgagcgtaaaaccgcaggtggtattgtactgacaagtgatgatggtaagatacgtggtattcgttgtcgttgggctaaagtatattctgttggtgaagacattaccgatatcaaagaaggacaatggattctaattgaccacggtcgttggtcgagaactattgagattgatggtattaaaatgaatctcgtggattatccagcagcagtaagtttggtatctgacactgatccacgcatctctgctcaaacatttggtcgttaaaacataaatctaaagctcggatatattatctgggctttttatttggatgaaaatacatgataactgatgatggaaaatatagtttttctgacgttacgttagtttctaaaaatggacgatttatgtttgaagatagaactaacacgaagtacgtatatgaagtttctcatgatatgtttaagtacttacttatcgtatcagcccaggccgaagcaatgggtgtgaagaacaaagcaaactcatttaattttttgtttaatcaacttgaaatgacagaagacttattcactgcattgttgtatgattatgcagattggatttcataaacacctaatatacaaggaaataaaacatgactacattatggactgaaaaataccgcccacaaactatggaagattatgtatctaagaacgaagccctacgtcagaagatggaagaatggattcgtactggtgatatcccacatattggattttttggaccagcagggacaggtaaaacttcagcaatcaaagtactactgaatggtctggaagctaacggacaccttgaccctagtgatgtaacaacactgaatatgtcagatgaaggtatcgatgctgttcgtgataaaattgacgcagcagcaaaactatcatgttttggtcgttatcgtgtatttgttctggaagaaatggaacaaatgaaccacaaagcacagggtagcttgaaacgtgtcatggaagattaccatgaaaatgctcgtttcattcttaccagtaatgaaccacataagattcagaaacctattatctctcgtgtccaggtcatcaccattgagaagcatgatatggaacaattcatgtcacgcatctacaacgtactattggcagaaggagtagatctaagcactgatgaaagtattgaacaagtacaaaaatacatcaatgcttcatatcctgatttccgcaaaacgctaaacgtattgcaaagttcagtagtcgatggtaaacttgtaaaacttgaagacagtattgagaactctgctgggtatcgtactgccattgttgatgcactaaaagctggtaacattcgtcaaatgcgtgagcagatcgtgcaaaacattcctgatgatgagatggatgcattcttctcttatctgtatcgtaatgcagaaatgttcagtactgatgaaattactctaatgaaaattaaggttaagattcgtgacgctgttgttaaacaagctaccgtgtctgaccgtgaaatgaatctcagtgcattactgtgtgagattgacctaatctgttcggggaacatgtaatgaaagaccgttgtattgtattcgactgtgatgaagtactactagatcacattggttcattaggagaatacgcaaaactccaatatgatatcaacccaacaacaccatacccactcgcatacgatttatccgaatggtttggagtttcaagagaaaaagttcaagagatcattactgaattcaatcaacgttcgtatatgtttggattactaaaacctgtagaaactaacactgtaagtattatgcatgaactgcgtgatcgtttttacaaggaaaaattcatagtactgactaagtgtggtaagaaaggttatagcgaggtacttcgcaatactaatcttatgcatgtatttggtgagacatgttttgatgaaatcatcattgttgaaatgaatgaatctaagcatgacgcactagtagaattaaaagaacgatatgacgtaaaactgatgattgatgattatatcaataatattgaaacatcaatggaattgggtatcccatcagttatgatgcgagcgtcccacaatcatatgtataaaaatggttatgggtatgactatgttaacaactgggatgaactacgtttaaaaatctattcagtactgtcgaaatattaccaataatatagtaaaaacaatggggattatttaatccccttttattgttttttaaaagtagtaaatagtattatatgtgctagttttttaaggataatataaaacatggatgatttagattatacagataatgcagtccagcagttgtatgataacagcggtatgctagatatacttctggctgttgaaaaatattttgatgataatgatttgtacgcatatcatggtatcatcgaaggtgaactcgttgaaggtccgattgttagtaagtactggtgtactgtgacattcaaatactatcgtgagaatttccctgatcctactgcattctcaattcttgagaagcacgggactaaggtatatgtgaaagcagattatgaaattacacctattcaagaacctaaccgtcaggctgatatgaagagtgtggcaacgcaatctggttctgttcgtattccgaaaaatgaacgaattccagttctattggttcgtgtacaaattcctagaaacctaatcaaccctgaaagttttgatgaatacaaactaatggcttccgagttcaatagtaatcctatgaatgcacaagaaccatcagatgagccaattactggtgaagatgttgatttagatgtagaagtatctgatgatgtacaacaaggtggtatgcaatgaaaaagaaactaaatgaacaaggtttacgtccacaagtactaaaggatttgattcatcctattattagtgtagatgaatatactcctaagattgaagatagtaatatcgttgttatgtttcaagtactaaacaactttgatgctgcatatgacctgtcatcttttattgagaagtctccaattgatgcagttgatactgaagctgctgaaacacctaacctggatggtcgttatcaggtattcgttgaaatggaacgtgatgcggaatttccagaaaacctacttcgtcttatcaaaactattgaaaacatttgcccaaatcctggctggaagattcagctttatggtgtgaatgatccgattgatgttgattttgatgaaattcaacaacgtatcgatttgggtattcctaaatccatcagtgaatttttagactttgctggtgtatctgttgttaaagaaggtcacatgcttgcactaaacactgcatatggtaaactacattacagtactggtagtggctttgtgtcagaagcatacgtaaaacagcttctatcgaacgatacgcaggtagatacatctcgcttaagttcggtactaggtgaaagttatagcgtcctacgtagcggtaatcagtatgtagtaggtaaagatgggaagtatttggtgttacgatgagaattttaaacatgcttaaatctctccatgagactaccaaacttcaccaagacgacaagtatcatcgtagtacaactaaagatttggcatgtagaatgtatatgagacgattcgaaatttctcgaatcggtaaaggatgggacgatatcaaacgtgaagatatcgaccctgatgcggtattcaaagcatacatggcacgaaaagtttttatcaatgagaaaactttttatattgacagcgataaagaacttgaagtaaaatttacgaaaggcttgtggaagatttggtgcttagagacgttcggtgaagtgttaccagagccaccagtaccagaaacttacaaagatctaaaagctatatttgacaatgaacatatacatacaaattactcactatatgaaactgtttccgaagcggtattttatggagagttgaacggtcataacaagtactttgatagtatggtgagttttgatttattctgtcatctccctggtatctctagttggacatgtgaccagcatcgagctagtaaggtagacaagcgtaagttctctgcccaacgctttatgcaagctgctatgggtatgtacaaattggattatcttgggtgtccagaaccatataaacatttttggaaagaacgtgcacaaaagtgcatgaactattgtataattcgtttaatggattcatacattttaaaattcagaaatgcaactgtgtatgatatgccggaaccaccaaagaatgaaaagtacccaccagtaaaaacatttgtgtggtacaaggacaagagtaacaaaaggatgcactaaggtgcgtcctttttttctttaaaaaatggtttgacaaatacatcgtgtgtatgtagaatgtacgtatcgtatcaattttaattaattaagaggttagtaatgaaaggaaaatattttttcattgacaacggcaaagaagttgaaatcaaagaatttaacttcaactacgttcttaactcactgttaaaacagtatgatcgttcatcgaatcgaaaatatatgtataccattgttgtggacagaacatacgattcattgggaaatccacatttcgacacccgttcactttcactcgacgagatctattttgataatcgccgtttgaaggtaatggatttgatgaaagataaaattcatttctcaaatgtgagaatcgttccagatctcccaattcctccgttagagaaggagtaccgagactggaaggaaggcaaacttcgtccaaacatggcagcagtagctacttcaccagaagttccggctcctattgttcttaagaagaaacctatcgaccctgaatgtgagatggttgctgacattgaacgttggatggaattcccagatacaattaaaaaagattcggtaaaagtactggattggtatgttaacctcccagtatgtgcacaagaagttggtatgaagattcagaagatctctgagcgacaattggatttgaacgcagcactacaacaacacagtgattatatccgtttattaatgggtaaccttacaacagcactggaaaagttattcccgttgaagcctacctttgcacagaagttgtttgggaaagcagatatcaaagttcaaccatctgatttaccaaaagtaatgaaagcattgaatgaggccgtgaagtacgatactaacaagtttagtggtattacgtctttattcactgaaattcgtgatgaagttcgtgaaatcaaaaatgaacttgagtatggtaagattgggtgtgaatatgcaattcgtcgtttggaagatccatttgaatatgaactaacgcttgaacgtattatgaaaatgggtatttcaacagcaatgactgaaactagtattgttggtgttagtaagcagtatcagattgacatgagccgaatgattgatattcaaactatcactatcccattgattataggtcgtttacaagctcaaactggtaaagcagtcgatgaagatactgccaatatcattcgcaacctagcgtatggaaataaagagtaaaaaaaatagttgacagtactgagtgttgcctgtagaatgtttatcactgagcaacactatcttaaattaactgaggaatacacaatgtccgagaaagaaatcaatccgaaaaaagcaacagttaaacaagccaaagcaaccaaaactgccaaacgtactaccaaaacagcagcacacacaattgacgcaactgatatcttcgaacaacagtccaagtcacttccagtactgaaagatactaaaggcaacagtatggctttaactgtgcagaatattaataccatcggaaccactgctggggcaggtgtaggacgtttggctgatgaaatcatgtcaaaagttaacgtcactgatgataataccgaattcggtaagtctattactactatcttgacattgactcgtgcagttgatattgatagtctacaggatgataaatcaatcgtaggctgggtcaaaaaactttttgttaatgctaaacagaaagttggcgatcagtacaaaaacagtaaagaacaaattgatgaaatcatgaacactcttcaggttggtattaaccgccagcatggggaatgtgcatggctagacactgcttacaacgaaaacaaaaactatctctttgaactgcgtgatacgttagttgagttggaagaagttaccaaagcacaagatgctgaattggtagcaatgcaagcgaaccctgacgttgattcttttgcaatccaggagcaaaagatgatttgtgaagctctttctaaacaggaagataagattcgtcgtcttatcatgatgtgtgaactgagcggtcctcgcctgatgagtatgaagaaagtaaacctcaacactgtttctaagtttgaggatttgaaatcagttgttattccagcatggaaatcacaattggctgaacagttgatttccgaacgtcaacgtaaagacaatgagttgggtaatctgattgacaatgaaactaaccgtttactcgaagtaaactctaaaatggtagcaactaacatgttggatgctgctaaagcaaataatcgtggtatcgtggatattaaaacattgcgtaatgtacacaaaacaatgatcgatagcatcgaagcagtactgattgaagagaagaaaggtaaagaagagcgtgagcgtgctaagattgaaatcgcaaaactctctcatgaactcgaagatactcttcgtgaaattgctgaaaaagctaacaagtaatagttgacacaagagtgcgttttcaatataatgttcttattgaaacgcactcttttttaatatacagataaggaacgaaatatgaaacgccgtcatgttagtgttgatatcgaagccctcggtactcctgaaaactctggttatgatattattattccaaattatgcagcagtagttgttccaagtaaacctgaacatgatatcagacaatttgtatatgttaagttaccataccaagcacaagtcaacgctgggctgaaatcagatgcaggtgcaatggatttctggatgaatacatgtcagaaggaatatcctaatgcatatgctgaagttgccagtactatggcacttgttgcaccagaattgtacggtcctaatggtaaatccaaacaaatctttacttctaatggtattgtcgatttctggaaagatatccgttttgattgttatggtaacgaggttgaacattcaatttggggaaatggctgcaacttcgactgtagtattttacaagccaatcacttaaaactattgaatgttggtgatttgtggaaatatgatgctcctgaaaacgcacgaaccctgaagcgtttattgaatgaagaagctcgcaccgaaatggatgagattgtgtcagtgcagttagctaaattcgtgaagtatgcagaaaaatgtggtattaatggtttggaattacatcaccctctgtatgatgcagcacgtgaagctatccaaatctcctattgtctcaataaacttaaactggactaatacatgaattttattattctgttgattccttcacttatcgttgtatttgttatgaaatacatgtatgataagcatatcagtactaaagaactgttgattcatattggttgttgtatagttggtgctgctcttgtgcttggtatctcatatgcaatcaactacagccaattgtacgatgtagagattctaaatgggcaggtaacatccaaatataatcacaaggagttttgtacacaatcaagctcatgtaagcattacacgtggcacgagaaatgcagaactcgttatgatagtaaggggaaatcccatcgtgaatgtgagtcctataaggtatttgattattcatacgaagttgactggtatgtaaaaagtactgtagggaagtttgagattgagcgagtaaaccgccagggtacaatgacccctccacgctggcaacaggttaacattggggattatgccgccgcagaaagttcttatattaactatctgttcgctgataaaaactcattgtttagtcctggtgaattacatgaaatgtatgatgagaaatatcttagtactttgccagaatacccaagtgtggtagactattataaaacacaccatgtaatcaacactactaattataatgtagatggttatgatgagtatctgcgtgaagaactaaaaactatgggtgcacgtaaacaagtcaacatccaagttttggtttatgattataaaaacgtagattttgttgaggcaacactcgcttcgtggcgtggtggtaagaagaatgatgttattatgttctttggaattgataatgatgggaagattgttaaatttgatagcacttcctttgcacaaggcatgaagaacgaagaactacatgctaagatgcgaatggatgcattaaatgaaaaattaactcttgacttgttgagaaaagaagtgcataatattgacacaaagtttgaaagactctctaataaagagttcgagtacttgtctgtaaaaatggaaccacgtaaagatgttctcatcggtgcttctattttattactgattgtatctattttcattggcctttatatgagggataacaagttatgaatggtaaaattattgcattgattggtgttgttgttgtattcggtcttatggcaattggttcagttagtatgtatgtagatgcacatgaccgtgctgttgaatttgaaggtaatattaaaaagtactatgatgcatcagaaagtcaactaagtaaatacactcttgtcattcaagaaaaagtacaagtttctgataagtataaggatgcattaaaagaaaccatcgaaacatactttaaaggtcgtgaaggtgttgaccagaagtttgtgatgtcacagattcaacaacaggttcctaatctcgatcctaagatttatcaagaacttatggtaactatcgagtcaggacgtacacagttcaacaatcttcagaaaatgaaaattgaccagtgtactgattatgctaagttccgtaaaggtttctggaactccaaaattcttgatactaacacattcccaagtgaaaatattgaacatttatgcacagtagtttctgatacacgcaccaagaaagcaatggatactggtatccaagaagtaattaaactataatctaaatctgggagtacattgtactcccattttctataggatttattatgtttttaaaaaatacttatgaattaattaaaatgcttcaaaatatgaatttcggtggtctattcccgtatcactctgaggataaaactcatcgtttagttttgaaattggatgaaactgggcgtattgcatcactaagaacggctgttccaaatatggatcaagtaattatgccaacaactccgaattcaggaactgctgttaatacaccacaaacatataactcaaactaccaacacccacagatgtatacgattagtactccatctattacaagagttgcttgtattgttactataaaagtatcaaaagactatcgtgatttaatatcagttgaatggtcagaactaacatcagcatttgcaaacaatgggcttgttgtaacaaattctggtatagcagtcaatgcaaaagaaggacaacagataatgagtgcgttgtatcttagcaatggttatgttatcattaatgggaagttgtattgtaacaccgaaccagaagcactcactgaagatttgattagtgaaaaagaatatagtcttcttgaaattatgaatttaaaaaaggtatatgaaaactgtgattagatttgatcaagacgatttgccatttatccaagaactagaagaactagttacggtaacgatgcaggaaattagttcatgggatataacagtttttaggaacgtatatgataaaatcacaaactttaaaactgttaatattgaggtaaaacacaataacttttacttaacaaaagaattcattctaaaaagaccaggaacgatccaaccgaaacgtaatttgtcttttgctcaagttctcggtgctaagacaagggatgatgatgatttgaatgaatcaatatattcgtatattaaagagcgttctcctgatgttaagaagagatattacctttgtgttacatttgatgaacaaggaaaactaaatgcgtattctataaattcatcagcacacgtcccattacattcaacgtcaattggtgataaacaattactaatcgattcatcaacatggcataatagggaaaattttgccactgaaacttttcagtactcggtatctgaaccaaagtctccatttgattttgtgtttgttaataacatccttttacgttttggggtaggagtctaaatatgctaatttatttgagtgttcttgttatttcattactggtatcattagtagtactgaaagttgttgctatcggtcgtagtaaaattgatagtactgaaaccagttctgtgttggacctaattatggatcatccaaagatctgtactgggattgttgtgtttgttcttcttataggaacattcattgtacgtacacatttatacaatatgtatgactgtagtgttcgttcaatttctcagggtgttgaaaccgactatagctggtactatgagaaatgtcgcttcaaaaaccagcatggtatttgggttgattttgataaactgcgtggtacaccatctggtgaagaagagtaattatgtttgaatttcctgaagagtcatttaactatattgaccctactgatgacggatacagacacattaatatctatagtaaagctaaaactaagttaggtagggatctatctaacttttcgtcacatagttttaccttagaaccatacggttggttcccatcggtagaaactttttatttttggtttttaacaggccagaaacatgatgatcttagaaaagtgtcgggtgctgctgcaaaagcagcggcgaacaagtatatgcacgaccgtattgaaatgacacccgaatgcatttcttgtatccaggatgcaatatgtgctaagatatttcaaaacccagaacttgctgaacgattgaggaaaagtaagttacccttctatcattactatgtttatggtgggaaggtggttgatgtatctgatgaacatgactggtttgttaaaacattcgaagatataagaattgttttgaaggagaaccacaatgagtaaatgttgggtatgttgtaagcaattcgatgaagattatattatttctttggatgtattaccacaacaatacatgatatcttcagggaaatataaactagatacagttccaacacctaagtatatggggatttgtccattgtgtaatgggaatggtgtatcgaatgaagttgttgcattcacaaatacacaaactactgattgtgtcgccgaatatataagaaagaatctggcttttttcactaggagattatatgaacgagagaatctttaattcatatgatatggaagatttactaataccatctgataacagtactgttaaaatgcaaatgtattggttagtaaaagatggaaaggtattccagcacaaagttacaaaagtatggcaatgtaataaaaacaaatctatagttgatgcactcgcaactgcatatcctggggtagaggttgtatttttaccatttgcctacattaaggaaataaaatgaaaaaaacatggacaatattcgtaatacctactataatgttgttattgtcacttacggtcccgcaagggcatgttgtggcactgaatgtagtagaaattattcttcttgtaattcactgcattgtatgttactattatgtaaaatcggatgataaaaaaatatgaagtactatcgaattcgagttggtgtaagctctggttttagtaattgggtatattatgatttacctgatagctataccgtagaagatgtaattgacttatattatgaagaagagtcatgggtatccagtactgaaacacacagtgttgtgtgtgaagaactgagtgctgaagattacaagcactgtacccaagcaatgaagtattacagtaaagatgtgaagatgttatctgaaaacgtttttcctgtaaaagaatgggcaattttgcttgcaaatcctaacaaacctgttagaataggttatccaaacaatcatatggtttatcgaatgaatgataaacgtgagctaagttatcagtatgattacagtgcttctaagtttggagttctaaaacaatttatgaaggcttatccagtatgagcaaagacagcaaagaatttatagtgcgttgtagttgtggcgataatacggaacattgtgttcacatttcacaatttgacttgacacaagaacatggagatgataaacttggtcaatgtctggtgagtatgcgtttgaatcctttcttaaaatggtacaaacgtgtatgggttgcattgaagtatattttcggcgtaaacgactttcaatacaaagaagcaatgattgatgttgacattctgaaagaagttgtgttacaattagaagatacccgctccgatgaggtaaagaaagaagaaagagataaacgtagtgatgtgaaggttttatgagtactgaactttatgaaaaaaagtactgtacaaattgttcaaccgagtatacaatacagggtatgttgatttgtacaatatgccaatcaaaacaggctgccacttttatcgttgatgatagatttggtgatttaaaacagtttaaagcaaaccgtaatcttcgtaactttagcaatctatataaggaataacacatgaatatcgaacaaactatccgtaaccactctttcttcgctgctgaaactggtcgtgtaatcgagagcgtcaaaattgaagaactgatgattaacgttaaatataaagaacagaatgatgagattagcagcaccatttgtgctctacgtgctccattccgttctgaagcggcgaagaaacctgcttatgtactggcgattgcattgggttgtgtagtgaaattggtcgttgatgaaaatcaactaaatatcaaagttgctccaaccaacgatgaagaaaacatcgacctgaactttgaaggtaatctggctgaagacgtattcttccaacaatcactggtttatgatttccgtaccgtaactcatgaccatatcaactttgtcaatgagatggttgacattgtagctgaatacgaagcttccctataattagattaacaaaagcctccgtaatgggggctttttccaacataaggatatgaataatgattgaccaaattaaaatcctaactgaacaaatcactgattttctagcagataaagatggattcagtactgaagttaaaatgcatggtgttagtctcgatgtaactgcaccaaatggtgaaacaaccaattatgatatgtatgaaatcctactttatacattggctgttcgtaaacttggtagtgatattgaactaaacattaacaaaaccgagaacggtgaccaagtgtttgcaatcaacactggtgcacaaatggacgtggtagctgaaatcaacaagatcaaccaatcttttgtgggtttcaagcatgatacaatccaatctgtgttcctgggtaaacaaaccggaaacagccactgtccttattgtgtaatgacaacctataagaatggtaactggatgcgtcaggatctagtacttgctgaaatgctttatgcaatcacacacggcctagaacttgaacttgatgatagcgtgtactgtttcaagaaaatccgtaaactttctggtgatatacaagctcaattaaaagaattaaatgataaataattataccagtaatggttaacattatcatgttactttcctcccttacataataatgatgcgttattattttattgtattattcccctttttcgtacaaaatctttttcgtactgccccgaccttcggggcatttttcttgtctaaattttgaggttctatgaataatactattggtagtacaatatctaaaccactctcttattaccttgaaaaattcagaagtacaaatggtaaaaaatttaatggtatataccaattctcacataaagaatatatcacagttgattgttattcaaataaacttatgtacgtagatgatactgaatactgtatgaaattgtcattggatgtagaattagataagttaacatttattgaatatacatccaaaagaacatcatttcttgggaaatgtaatcga

SEQ ID NO: 28 - DNA, 72689 bp, Unknown
  Podoviridae; G7cvirus
tggctggggctacacccttacactcaactagcccccccggtatgttgacggtgtagccactaccctaccccaccttacacgttacacatgctccgcatgttatggacatgtcgtcctatcatcaactattggagctatcatcatgactactaccgctactgtacgtatgaccgcaggaactttacttggtactgttaactcagctgctactactgttgcagatacatttggtacagcaactaaagcagtaggtatgcttaattcatatgtaagtactatggcagagaaacaagccatccgtactaaattagaaatgcatacctttgttaataaactggcagaggagacagctatgactgagactctgcgtaagaaaagtattgaagaattctgcaaggataaagagaacgctcggatctataacgcagaatattcaaaagtaatcgacatcctgactaaaagctaagtcacataggaggctcttcggagtctcctgttttgaacattagatagatagtcaaaagtagataaatatctactttaggagaaataaaatgtccctgacagattgcaaatctgaatctccgcaggaagcattagaacgttttgaagaagccgttcgtcagcaagagcaatatcagtctgacatccatcattatggagaatcagacatagatatctcagacgaaactgtagaaagtaagtatcagaaagctaaggctgaattactaacctggttgtcctacattccgtaaaaaccaagacgctccgcgtcttatggatgatgtaaatgcatccactaatcattgaacttttatccttttgtttgggtgttctcaccgacgagttcacccgtaaatcacataaatctggagagtacaaaatgtctattcaaaaattcactttcggtcaatctaacaatgctgctacttctactactaaaactgataagcctaaagctcagttctggctgaacattggctatgtagctaacgaaggttctgatgatgagaaattcatctcattgcctactggtattccgctggatactcaggaaccgctgcctactaatagcagcaatgctgacttccgtgctatgcgttgtgcacagaacgacttgctggaacagttaatcgaatatgctcagaacctggaaccaggtgaagaaggtatcattaacctgcaagttcaacttcgtcgtgtgaaagcagaggctgctgacatcccagcagacgagaataaatatgctcgtaaactgactttctaatcaaccactagactcccttcggggagtcttttatttttaactagacgataatctatttctactttttgagtatctttagacgaagggtactgaaacagtaaccagatagatatagatttatattagatgaaggagtaaccattatgcgtacagtatgtaaccgttataactcacaaaagttgattgttatgttacaaccttggggtagtaagatgtctcttaatgctcgttggcaggtatctgtagaagataagaatggtcagcattatgaccacttctttgtagctaaacctactcgtaaacaaatccgtaaacttcataaggtgtaagactatgttggacttcattgcgtttgtaatactctgttatgtgctgtatcgcctacgtggttacattctcaatggagccaagtgggtaagaactaagctggtacttatctgtaagttacctgttgtattcgttaagtgtctgtttgcttccatcgtagctaaagaggtacgcaagcaactatgggctaaagaagcagaagagtttgcaaagaggaaccagtgatattcactaacatagaagatgccattgaagagtgtatctttcgtagatatcacactggtgtacagaaacgacactatggtgttgtgcaactcaatggctatcaaatggttgtaagaattgtacgtaacagcaaaccttttaactttatgtggagtactaaacatgcgtaagtcattaatcatgggaaccaaagctgacgtacagagaatgaaggaacgtctggctgctaagcaacagacatctgaaccagtacgtaagattgttactttcaatcataggtgtatcaaataataaggagtcctccaataggaggctcctattttttatttttgaatagttagatatgtatttaaataggagaaataaccttgaatgaaatagtatgtatacttcctcaccaagctaaagtagctgacaggaatatacgggtacatttaccattcccattaagtaatccatttgctcgtaacgaaagaaccacggtagaagatatagaggtagcttatgaggcttaccttcgtaatcgtcttattaatggtgacaagttaattacagcagagatggaaaggattgctggctttgtaactgatagtacaggtaaacctgttggtttaattggtactgaatctgatgttaacgttattcgtaaaatactgatggaggcactcggtgaacaatcttagtgatgtcatcgtagataaaacaatattagtaaatcccaaagggtatgcctggttcatgctaaagcatacccgtaaggtatatgttagaaaggtatatatacgtaactttggtaagttatcttacagagaagtacgtattaataatgagatgtactttctagatgaatcagtgattatcaaatcaactgaagacagaaaggctccttactttaactattacggattcaactaaaatgatgtactcaactgattatggtgtttgccctgtatgtaacaaacgtaaaggagttgctaatcataagcgttgtagtcgtatattacagaaacaacggaaccagaaagaatgggataagctgttggaaaaccagcataaagaagaaaatcaacagatggctgttaaggcatctactcaacgtattcgtcgtattaactatatacaggggtatcagaaatgagactaatcgtagctggtggaagagacttcgtaaataccaatcttatgattgaggaattacagaagttagtaaattcagtaaatatacctgaatgcccagaattagtatgtggtatggctcgtggagcagatatgcttgcatataatctatgggctaataacaaaatgcctattcataatttcccagcaaactgggataaatatggaaagtctgctggttatagacgtaaccaggaaatgggtgaatttgcagatgctgctgtatgtttctgggatggtaattccaaaggaaccaagcacatgattgatatcatgtataggcttaataaacccgtatacgttgtgaggtactaaatgattattacatatcctacaggcaagactgtggaatatatgaagcacaccattcaagtacctcactgggttaagtatatagctttattaccacgtcaatataaaagtgctaatacctcattaataggattctctaagaagcctaagctaacagaaaacaatatctgggtatcctctgggagacaagaagaaattggtttttgtgatttgagtattgtcgataataacatctatgggacattgagaaaggtatgaaaactattctagtagttcatgattctacatttacagatgtagataaaatgatgcgtaatattgattatgtatctcaaacaagccaggcattcaatgaagaatttaccctctactgcaatgctgaatctccactggttcctatccttaaagaatcaggtctaccattctctacagagaacttcccggaagaaccagactatgtaatctcattcatttatgacttacatgatggttctgaaactagtgaactagctatgaaccagtggcgtagtaaacgtcctgtgttcgcattccaggtacttaagccatgatttataaagaatattatgtattcaaaaagggggatgattttatagctatgccggatgattatatagattggcatacaactcccgtattaaatgaagcattttctgtacctaacctagaagaggttaataaagtaatgaacggggtaatgttaacaagagggttagcttacaaaatagacgcattagaaggaactactgtatgtaaagtaagtacatctattgaggcattaaaaccatgaagactattacattaggggacgacaccaatgctttgctgggtgtagctgcacgtccaattatcattgttaataaacatcacggtaaatccggtgagtatatcggacgtggttcaccattaggaaatccattcgttattggtaaagacggttcaagagaacaggttatagccaaatatcgagtatggcttaatgaacaaatcatgaggaagaatcaagctgtattggatgaacttaatcgtcttggtaataaagccattgatgagaaagggttggccttacagtgcttctgttatccgaaaccatgtcatggtgaggttattaaagagaagctagtaaaagctatgtataactactttgtggagaatccaaaggggtaactaatgaaagaaatattcgtattcactaccaatacactaggacaacataccaatgcttctgccaagttagcttataagaaacatggtgctcgttggggcatggcctatggtcactatggtaatagctttgctattccagtaagagatggcaatggtaaccgtatcaaagagggtgctatctatggcttcattgagggctttattgcttatgcatctgccaatccacaatgggatttcaaagtcatgagtaatgactacctggacccataccagttcattaatgtaaccggaaatgtactgttacccgaagcatggcgtaaacacttaggcgatgcttacaactactggagttaataatgacttatgaagaactgtgggctgctcaagtcagagccagagcacttacacggcatgatatctattgtgcattacaaaacgaactaaaggatcgtactaaactaggtcacatatctggtttaattaaaatacctatgcgtagtctggtatggccttaccagaagaaaaataacgagtttagtggtaatggtttatatgtacgtattgactaccttggtcaagagaacagtattcgtattaccttttggactaaacgttaggtaatagctgctccgcagcttttggttattaatcacatttaggagaataagcgatgtactcatccattgaacatcagaagcaactcgaaattcttttcaacaaaaatcaattactccctcgcatgaggaaggaatttgaggactccgaagaaattgactttaaggcattcgctgcctatttggaaattgattataagctgctcattgatgcaatggtgcagattgccctacataaacgtgctgaccttcagactatgattggctctcttatgagccattcagatgatgctcagtacatcgctgactgtctgtataagatggcagagaatgactgcttcaactatgaccctaccatcgacaagttcggtgttatctacgagattagtgaagatgttcagatggaactggaagcattccagtatccattacctatcgtaagtgctcctaagcctgttctgtgtaaccgtgatacaggttactatgagagcaggggaagtattatcctcaagaagaaccatcatgagatggatgtctgtcttgatcacatcaaccgtatgaataatcaacgtctaagcattaactgggacgttgctaactatgtaaaagactctcgtcctaatatggataaacccaaagagggtgaaacccgtcaggaatatgagaaacgtgttaaagcctttgagaagtacagccgtactgctaaggaagtaatggagttagtgaccaaagaaggtaataacttctcactgggtcacaaatatgacaaacgtgggcgtacttacgctcagggctatcacatcaactatcagggaaccagttacaacaaagctgtactggaatttgctgataaggagttagtaaataatgattaatcatcgtgcagtaaaagacttctatgcccatagggaattggtactaaaacgtatcaatgaagcaatgaaacgtgaagctgaagctaaacgtaaccgtaaataaattcaaatgcgagccaagaggactaatcccaatgagtgagttattaaaactatggcttattagccagaatgagcgtaaggggtgggatacgttcgactctgctgtggtagcagctaaaaccgcagaagaggctcgtcttattaacccagatggagaatggagtacatactccgcttggtgttcttccccagataaagtgcacgtcgagtacctgggtattgccaccgaaggtgtggaaccaggaatagtattgtcatcatttaatgctggctaatacatccaataagcaggctctccatagtggggagccaagaagcaaaaggaacataaaatgcaactgttaaccgctcgtgaatacctgaaagtagatattgccaataactatggtctggataaaaagacctgggatgagcgtattgcttggttcgatgagaatgaagctaacttgcttaatctggtagatgaagctgaggaatctgcactgttctatgctggtgtaaacgcatggaaagatatgaaagctggtaagcctatcggatatgccgtagccctggatgctacatcatcaggcttgcagttactggcctgcctgactggtgaccgctctgctgctgaactgtgtaacgtagttaattacatgggagagaatggtaagccattacgacgtgatgcttatacagttatatatcacaagatgctggacatccttggtgaagcatcccgtattaaacgtagtgataccaagcaggcagttatgactgcattctacggttcagaagccaaacctaaagaagtattcggggaaggtatccgtctcaagacttttgaaaatgtaatggaaacagttgcaagtggtccttgggcacttaacaagttcttactgcaatgtggtaacccggatgctaaccgttacatatgggtactccctgacaacttccacgctgtcattaaagtcatggttcttgaagtacagactgttaacttcttgggtaaaccatttgacatcactcgtatggttcagggtactgaagagaagacccgtatgctctctgctaacatcactcactctattgatgggatggtagtacgtgagatgctgcgtcgttgtaacttcgaccctaaactggttgcctatgtacgggaactgtgcgatatcgggccaagtgaataccccgttattgaggggaaccaagagaagactatggaaatctggaatcattatgaaaggtcaggattcctgtcgctgtctatcctagacttccttgacccgaatactattgcactggtagaccgtcaagtagtagcagatatgatcgacactatgcctaagaaaccattccctgtaatgactgtacatgattgcttccgttgccaccctaactatggtaatgacctgcgtcgtcagtacaatcagattctgtctgacattgctaagagtgacttactgggcttcattctgtctcaagtactgggacaagagttctctgctggtaagctggatgacagcctctggcaagacattctagaaacagattatgcattaagttaataaactagcctcattccttcgggagtggggctttattttttgcttggaggtagcaactatgcttatcaattttgaagtaatctctcagctaatactgatagttttatctgtactggttctggctacgatagttcgtgcccacaagtctaagtttgcttactgctactatggagcatactcactaggatgctttgtaatggcaggatggatagcttttgctatctactgtgtaaacaactaaccctcttaacggagggtttatttttttacatgtcatgtatactaatcctgctatttacttatgaggaaattcatatgccaactttaaaagtaggttttaacaaaaccaccaatgtcgcaactgtactggatgcgagtggttctatcccgggtggttcagtagaagtaggtacttttgtacacccggatgccacttacccagatagtttagttatttttcatggtgttcgtgatctgctgtataaacgttctgctaaagacccatctgaagaaggcttctggcctaacaacatcgtagatatgcagtccatctctattgatatgcaagctactccacgactgactattgctactaagctgcctcgtgtagtctccgctatcgaaggcgaagatattaactggcatgttgatgtagcaggcggtaaagcaccatttacttataaatggcagttcaaagctgatactgctggtgcagcattcactgatattagctctagtactaacccatctgctgctactgcaacattaacccttaatgacgtaaccgctgcttctgctggtacttataaagtgattgttactgatgccaatggaaccactgtagaagataagtctctactggctgttggctactacgaagcaagctcactggtagctactcctgcttcattgtctctgtctgttgctgctgatgctacttctggtaagactgtaaccattactaatgtgcctattggttcatctgctggtactttgtctattaagactgccccagagtctggtcgtgctacggctaccattgctggtaacgtattgacggttaaacctgtagctgctggtgaagctacttctgtagtagttaccaacggtaaggtcgatgtaaccatcgctattactgttgtagaataaaggtagcctttatttggggttgtaaaccctgatataaaactcccaagcttgacctcccagatgaagggaggtctttttttgacttaaacattctggagccaggaaatgtataaagagattgcatttttctcattcttactaggcggtttattaggtgcaggatttgtagctatttctaatacctactttggttctactccaaattctgtaacacaaaccctcaagcatgaatgtgaattgaatatccctcgtaatcaaaactgtgtaatgcagttcgtaccggagaaaaaatgaatatccacaatctacgtttggttgagaaactgtacgaagaatacaacgacaaccgacagcaattagctagtttgaagaagtcaccacatatggtgaaagtatcattcaatggtacggatttaggaccgcaagctcgtacaagaatacttcctgaactgctgtcattttatcaaaagagaattgctgtcttagaaaaacgctttgagcatttatgtgtagatttatcaccactcccagatgaaggagaagatgagtgaaattaacccagtcccaagcaatcttccttcgtatggttcaaggtggttctgccaccagcaaccgcaataataaaaccgcacagtctcttaagaaactgggcttagtgcagttcaatgctggtcttgggtggtcattaacccctactggagtacttcaactcaacgagttaaaaggtaactaaatgaaaactttaattgctgttgctgtagtagctttatcagttctgtcattcaatgctcaagcatccagccgtgaaactctgttagacgctgctgccgactacaaagccaataatgcaaactttgtgaaccagggttacttcatgggcatggttactatgggtgtagaggcaggaaataattgtgtaccggagaatatgaagttaggagccatatttgacagagtagcttctattatcctgtacgaccgaaaggttaatgcagtaaaagtgccatcagacatggttctgttagcaattgatacagcatacccatgtattaaatcttaattagtaattccattaactttaggagagtaagtaaatggcgagcattgactcactgaccgtatgtaatacacgtcaggcccgtaactttattatccgtgccctgcaagcaggtaacgtaccgttcctgacttcatcaccgggaatgggtaaatctgcaattattcgctctgttgcagaagaatttggtatgaaactgatagaccatcgtctgtctacttctgccccagaggatttgtctggtctaccattccgtaatggtgaccgtgcagagtttatcccattcgctgacttattccctattgagggggatgagataccggaaggatataatggttggctcctgttccttgatgagttcaactcagccagaaaagaagtagtagctgctgcatacaaactgattctagaccgtatgactggtcagaaaaaactccatcctaatgtgatgattatatgtgctggtaacaaagctactgaccgtgccattgttaacccactgggtactgcaatgcagtctcgcgtggttcactttgaaatggaacttaacttcgacatctttgttgaagacgtaatgattccacaagaatgggatgaacgtctggttgcattcttacatgctaacccaggttatctgcatgacttcgacccagcccataagaacaaaacgttctgttgcccacgcacctgggactttgttaacaaagacctcaagaaccgtcctgaaggtgctctgccagatgaagattctatctactatgcaggacacgttactgctggtaaggctacagaatttgttcagtttactcaggtatacaatcgtgtgattacgattgagaaagtagtcaaagacccgttaggctgtgcactaccagaagataacaacctgtgttgggctaccgttaatcatctggctaacaaaactactgaagagaacttcgatgatgttattcagtacattgaacgctttaaaacattcacccataagattctgtacttccgtacagtaggtagagcattaccagaacttcaggctacccctgaatggcgtaaggctgctgctaacatctctcgttacattcacggataatcacagcatgaaccggatacctcagcacacactcagtgatgaacaactcatgcgtgagtatgaccgtactcaggccaacgctttcctaggaagcagtgcagcgttctttggttcattactgtgtagtcttaaattctcatggaaacgtgaggattgtcccactgcatgtactgatgggatagagcttcgtttcaatccagacttctttatctggatgtgtccagatgcaagaaaaaccgtactaatgcacgagctatggcatgtggcatatttacatggcatccgacgtggaagccgtgacccagaaatctggaatcaggcatgtgaccacttcattaaccttcagttagaggaagacggttacaagttcactggtatcgacgaaggtatttgcaaagaccctcagtataaaggatgggtcgaagaagacatttatgatgacctgatgaagaaccctcagaaaaggcagaagccgtcagggggtgttggagcaggtcttgctggcgacatgaaatccccctcttcggggcagtcccagggtgctgttgtcaacaacgtagtacgtgcaatgcaaagtcagaagatggctggtggaacaatgcctggtaagggtgctggtcgtatggaagaggttattacccaattccttaagccagtggttccatggcaagaagttctgatgaacttctttaccgacattgatgatactcattatacgtgggccagacctaaccgtcgttacactgacatctatctaccttcactggaagatgatgaaggacgtttacgacacttggcctactttgaggatgtatctggttctattagtagtgctgactctctgcgatttaactcagaagttgcctacgttaagagccagttcaatcctaagaagatgtccttaattaccttcgacgatattatccaagaagaaatagacatcactgaagaagatacttttgaagagattaagattactggtcgtggtggtacaagccttgtgccagtacgcgagtggattattaagaataagccaaccgctgcaatcatattctccgatatgtatgttcgtccaatggaagaattaccatttgatattcctatcatctggtgtgttctgaataatcccaatgctaccgtaccttttggggaggtagttcatatccctaaaggaatgaaataatggttgttaatggtaattctctataccgttcatctcagttgctggatatcccagaccgtaaggtatcagagcatggtgtaagctatggattaggtgaagctggttatgatattcgtatcaaacaagatattaccttctatcgcttatttgggctgattccaatggtgaaagtcgttgatggaaatcaagtatcacgccatctcggtaagttcgccttggcctcagcaattgagaagttcaacatgtccccgtcctgtgtagcaatcgttcacgataagtctacatgggcaagacgtgcattatcagtgttcaataccgtaatagaaccaggatggaaagggtatcttaccctcgaactggtctatcacggtcgtaagaaattgcatatcccggctggtgctgggatagctcaagtattatttcatctggttcaggaacctgctaattacaatggcaagtatcagaaccaggaaaacaaaccagtagctgctagaccttcaaaataaaaggctatccggcttaattaaggaaaactcatgtctgtatttcaagtaacacaagaaaatactggtattcgcctgacccttaatgcgaaccaagtaattgcagtgcaagaacttaccgcaggtaactctgctattactaccgtaggtggtgatgtagtaattaccaaagaaacctatcgttcagtacgtaattacctgaagaaagctcttgctcctgcaagcaaagatgctgagtaagtagctgcttaaatagcccagcatagttgggctatttgtgaagaaactaactcaaccccacataggaaccatcatggaatctttagcagcaatccttgttctgttatttgtattagctgtataccttatccctactatcattgcttttgcacgaggccatgcctccaagtggggcattggtgtactcaatattgtattaggctggtctttagtcttctgggtagtagcactgatttggtcactgtccaacaaaggtcagaaccaagttacaaacgtaactgttgttcaaaccaatggtggcagtaaatcagagtaactaacctaagcatcattacatagtgatgcttgtggaagttacttccagctcattgcttatccatctcctaacccaagcccacctaacccgtgggcttttttatttacaggtactcttatgtcaagcagacaaaatggtaagtctatcctgcaagggctggacttaagtaagctggaacaaactgcaatgcttactctaggtaaaactatccatgatcaagtagagaatgaaattgagttagatctttacacgacaatgcaggctcttgttcaaaaaggatggactattagcagaccttttccttcatacattcctccggaacctcatctgaaatctaaggtagaccgaatcatagataagttctggcttagcccatgtagggatgatacgtatctttacctggctcaaatacaaaagaatcctcgtactaaggatgtgttcaaaggcaagagcactacccatcattacccttggtatagaagaggtagtaaatactaatgcgtatcccattcctacggaaaagggaacgaaatcctgttctttacaataaaggcatagaggatgagtatgaactcaaccgtaaagctcgttcctacacaacaaaattattcatggggactaacaatcctgatagattactggactttgtttttgaacaaatctttatcatatacagcttagctatgtctgctggttcacaagaagtaagtgataaggcaagagatgctctctgtatgctccgcagggagtatgaagccctcatgtatgaagacttatactcctttaaaaaagaaaccgctgtagcgtgttctgtggcccttactgaaggtgtagcagtattacaagaactaccccgtagtgagtttaagctggtatatgttcaggttaagaaaattacagaaaaccgtagtggtatcaccaactatctaaggtcattctaatgattaaggcaactgtcattgcagattccgttcacccagaaacaggaactcgtattactacctttgaattggtttatccccgattcattcacagtgagtttatgacccaccgtgtattcaaccgtaatgcctcaagcagtcgtgctattcccacggctaagttcatcgaacaagttcgtaatgaaccagtgatgcctagtcactggggcaagaaccagaaaggtatgcaagcagaagaagaactcactcctatggagattgaggatgctaagtttatctgggataacgctgcatctgctgctgctgtgtatgcagaacagctacgacgtgggcaagtacataagcagattgttaaccgtattctggaaccattcacgcatattcgtgtagtggtaacttcaaccagctgggctaatttctatggactgcgtgaccacaaagatgcgcaaccagagattcgtgaactggctcaagcaatgcgtaaggcacaggaagaaagtacaccgagagcattaccatatgggcaatggcatctgccatatattgctcatattgaccgtgttggggcttacaatttctgcaaacgcaatcgagttacacgcgatgaaccaagtgatgcagaagtgcatggactacttctcaaagtaagtgctgcacgctgtgctcgtgcttcctataacaacttcgaaggacgaccatctactatcgaggaagaccttggcttattcgctaagttagtagaaaaccagcctattcatgcttcacctactgaacatcaagctacacctatgaaccttggtgaaaagtatgtgaataacatgaacccagttacatgggaacaaggtgttacatccatggataaagaaggaaatctgtactcaggtaacctgcttcactttatccaattccgtaagttaattcctggtgagactattactgaatgaaaaaactagctttgtacgcaatgctaattagtaccctattaacacttaactacgcatacaaagttgcctttgtcgtagaaacagatatgcagttcattcgagctagtattctgttctttgtgagtgagtttggattatggtgtgtttactactttgctcatgactatgaagctattcgtgagcaagaggaagtaaagaaacgcatgagacgtttcattgaaggaaaatagtaagtaaacctaagacctcctcctggaggtctttttttgattctattaactcttttaggagggcgtatgcctgctaaataccgtatcaaagacacaccagtaatgtgtgagggtgagaagggtgacattgtatatgcctgtatacaggatgacttcaatgctgctctgatgttaactcaaatgacaaatacactgcatgtatcagtaacactggaccctaccggtgactatccatgctttcccatccctgctcataacctggagcaaattcatgattaatcctgaagttattcatagcaaaactggaaaagctgttccactcagtgagattgcagttacaggtgatattgctgcttgcccagctaacatcgcttccttatgtatgtgcattgctgcactggcagaagaacgtaagttatggctggaaccaagcaaggaaatgatactggctggtatgtctgaactaaatgcacttctgaaagaaatgtatgacgaggatgggcaactagttgaaccaactgatgaccaaatctcggatgctgttgtattcacccttcaagcaatggcaagtaaacgttaattaaatttaagaagcaacacttaaactggagagtaaataaatgttagttgcagataccaatgaagtagctacctcagcgacactgggtggcaaagaaactattgcctttggcatttccgatgacccggcattcttccatgtattaagtacttccttgtataacaatcctactctggcagtagtccgtgagactatctgtaatagttgggatgctcatattgaagcaggtaagactgatactcctattcgtatcactattgatacagacaattttattacattccgtgactttggtaatggtatccctgatgaactcattggttccatttatggtgtctatggtgcatctactaagaaatccaacagtagtgttactggtggttttggtttgggatgtaagtccccattcgcttatacagatagcttccaggttacttcatggaaccgtgggaagatgtcagtatataacgtagctaaggctgcgattgagaatgacggtaagcctggcattgttcctattgttactggtattcccactgaggaatcaggtctggaagttaaattccagttaggtaagcatgacgtaaatacctttgtgcattacattatatctattgtatttaacggtgagattaaagctgaacttagtatccctaaacttgttaaaacagaagaaggtaatagtattcagcaaggtgactacactctactgaatacattaggtatgtcatttgaacctggttcatatgatatgtctgatagctggtataagggttatatgggtaacagtaacatattcgttcgttacggtaacgtaatgtacccaattgtatccagcccagctagtgaagaggctgtgggtcttatcctcaactttatgaacattattggtgctgctaatttagtagttcaggctgcaccggatactctagctattgctcctagccgagaaacactgtctaaccaaaagttaaccgacgatggtattactactctatgcgtagatttagtagaccgtatggagaaggagattaaggctaaaattcctgaagctattaagcagattgaagaatacgcctctaaatcatctacccgttattgggaatattcatctttcttacttgcagttacagacagaactgttcaacgctatatgtcctctagcttgtgggctaaacaacgtaaacatcacatcaaacattggcgtaacttatccaataaagcattattagctcgccctgaatatgcgggtcttaagaagctgtatagtaaggctatgagtgctcttaaagatactcgtgcggatggtacaagctacccattccaggaattagtataccggcatctacatttacctcagcttgctgctttaaaagaaactggtattaagtggtctggttacatagtgaaccaaggtaaccgtgttgatctggtgagaggtaaacttactgattactttaagatgggctataactgccatttgggtattggtattttcactaccaagaacgttgtagttactcgacgtttatctgattgtgcggactctttctcatacttccctgaatacaaccgtggagacttagagcgtacagcttttgttcacgtcgttggtcctaagaaaggtgcagcagaagaagctgtagctaagttcactgctatgggttatcgggtaattgacctcactcaatataatgagtgggacaaaccaactaactaccgcagagaacaagctaagatagctgctgagaaacgagctaagacgatagctgccaataaaaccaaagcagggggtaaaactaatgctctgatttcgttgaatgcagttctcggtactactcctgtacgaaataaaagtggggattgggattctaagccgtacattgacaaggattttactgacccaagcttccatgagaagtacggtttcactgaagtggaacaacctaagtactacgtgttagccaatcaggttagttctggtagtccagtaactgcccggattggaaccatgtggaaatggtatgagttatccgatgagatgaaagcagagactgttgtctgccgtaatcaaatcgaagctaacaaggctaaacgacgtggtgctatccacattgacgatgttcgttttaaggaactgatgcctgtcattaccagcaagggatttaagaagtatgtcactgaacaccgtattggtattctggaatacgtaggactggatgacagagagtattgggaaatcctagatattcttggtctaacgttcaaaccattacagaatctgatttttaaaccagagtatgaatgggcttatgatttcttaagaaatcgaccacataacaacaaagaaaaacttgttgaaatgggttgtattaagtcagttgatgacttagagccatatacaatgatggttaatccgcgtaatcataagtactttgaaatacttaatcagtacaaggggttattcagctatagctggagtgctggtgacatactacagagtctggacttggggagtttagttaaacacctcaagaaaaatccagaggatattcctgggtttaagtccctctaccgtaatcgtctaaataaactgaaaggtaactaatctgatgaaaatcgaactgatttctatcatcgcactggcagttgacagtcgaaacttaacattgtggaagcctgatggctccacaattgtatatccacagagcgacccacgggttgctcgtatcgtatctgaagcacaaaccaaaggcttgggaattaccaaagacctgatagaagtaaacattgcaccagaagtatcactgcgtaatgagtatctggaagcagagaagaacactaatggattcgtccgtttcttcaaggtagctaaagctaaactcaaagagttcttccaggatggtacagatgttcaacctacccaagccgtttctgatattaagctaggcaatcccaccaagacattagtatctaaagctatggatacattcctggctgtacaagctaatgaaccagaagtaacagtatcagatggttgctacgacagacgtgacaatctgatgtggattactggctgggataaggaccataactatcctgcactggttcgttttattaacgacgtaatgggttgggggtatgaacaaaccaacaccatgctcagacaggaatggcctgttgcagttcgtgcagtatccgatgatgaaatgggtgagtttgctaaacaagccaagcacatcaaaggtgtacatattgtatttaccagccgtaaacataccccaccaccttacattgaagtagctaaaactacgaaccaggataagctggctgctgcatccgagaaattagctgcattaggtgctattagtactgataacgctaactttcacactgatgtgaaggaagatgaagtggttgttgctgttaccaacgatggggttatccctggagttgagaacctgcaacgtcacttacgtcagtctgccaagttgaaagactacaagggcttcactaagttccttgagcgtctggctccggttattaaagaccgtctgcactcagtagaagacctgatgaagttcatggaaactgctgaattgcctatcgctgatgatggttcaatcctgttccttaaacgccttcagtataaagggaaagaagatggtaaacgtgtattcgttgactgtcactcaggtaacatcaaacagtgggtaggctgtaaagtgcaggtacgggaagacctggtagatcctgaccgtcgtcaggactgttctaacggtctgcatgtagcatccatgagctacattcgtagcttcggtggtaacgtaactgtccttggtaaagtagcaccagaagatgtgtttgctgttcctcagtacagcactaataagatgcgtgtatctgcgtatcacattattgctgaactacccgaagaggaacgttgcaatgttaacagtggtatctatttgtctaaaactgaagtaggtaagaaactacttaatgatgccatcgttgggaaccatagttcacctaccacacttattatggttggtgggcatcgtggtactaacctcaaatacactaatctcacatctggttctgtagagcaattccgtacagttgctagtaaagaggcactgaatatggaagagtcactgaatgaagctgtagcttctgaaccagtgaaagctactgaccttaaacccgttattaagaaggctcctactgtgaaagaacaaatccaggaactggttaaagagttccttaatgcaacaacaccagaagataagttagctgctgctgaccttctggtagaactgcgttccaaagctcgtaagccttgggctgcatttgatgtaggtagtgacgtggtagctaagattgctgatgtacgtgctacctatacaactaagcctattggtaaacctaaagctgttaagcaggatatgacagttaaacctacccgttctgctgctgccactaaagtagctccttctggtaaacacgttgataatctgcgtagcatcctgaacgatacgtcatattctgactatcagaaaggccatgctctgcaagactataaacgtcatgctaagaagtcattcactgcaatgggtctgactgaagaagaagctaaattagctaccaagctggttaaagcagttaagtaatagcctgttcaaatgccctcacttgtaataaagtgagggtaattttgaggaggaattgtactatgagtaaagtattcagaagtaatcgcaaagcaactgatgaagacatcattcgtatgaatgctgttgggctgtccctcgcaactatcgctaagacgttgggggttcaccccactacggttactttgcgattgcgttctttaaacattgaaccagccgacacacgtcggacgttcatggaaaacgtattacgtcctttaccaacccatgtggctgattggctatcagaacaagttggtcctgcttatgaaattcgttcatatgtaagggacttgattctggaggcatataataatcgccaccttaaccaagagagtgagcatgacaagttcatccgtttgtacgctggcaaatacggaagcctggttccggaaagcagtaccaaatccgacgagtaagaatattagtacccagattggttgtcatctggaagaagtagtagagatgctagacgagttatacgctaactcagaagatgcttacgatattcttcacaatgccattgcagcattaaccgaattgtctgatttaatgaaaaaagatgacaaagaggtatatgcaccgaacagccatcgtttagctatccttgatagtcttgctgaccagattgttacagcaaccggcgtcggtactttccttgggatgaatgtccctggagcattggctgaggttaatcgctctaactattctaagtttgaagatggggaacctgtcttcaatgagaacaagaaagtcatgaaggggaaagactacactcccccagatttgtccagtttcatttaacgaaagccccaaatggggctttctttctatggagtcatatatgaattggcacgctttatttgaatacatagatggaaagctctattggaaagttaatccatctatggcagtgcgtataggacacgaagcagggtccataaatggagatggttacattcaagtaggttacaaaggccatgtttatcaagcacacatagttgtgtgggaaatgcacaacggcccggttccaccaggaatggtcatagaccatgacgacaggaacagaaccaataatcgaatagataatttgaacttagttactcaattacaaaacaatagaaacaagaccaaaagtaaaagaaacacatctggtgttactggagtgtactggcacaagcgtgaccagagatgggtagcatcaatcaggatagaaggtaagctgaaacagttgggtcagactacctgtctggaggaagctattaaattaagaagggaagctgaaataaaacatggcttccataaaaaccacggtaaataactggagatttaaatgttttccaaacctaccaaagccccactgaaccaggggcaagaagcggttgcgaaggagttcttcgacttcctgctcgaccctaatgctaccgaattcaatattagtggcccagggggaactggtaagacattcctgatgtcgcacctcattgatgacactatgcctgcatacatggaaacttgttctttgatgggaaccaagcccctgtataacgaagttgtcatgactgcaaccacgaacaaagctgctgaagtactggctcaagctacaggacgtccaacatctacctatcactccttccagggtctgattgttaaaaatgactttaagactggtgaggctaatgtcgtaccatctaaatcattcaatattaagaagaacaaaatcatcttcgtagacgaagcatccatgattgatcgtcagttacttaagtatgctcgtgaaggtactcaccagtgcaaactggtatttgtaggtgatgcttctcagcttttacctgttaaagagaataagtctccagtgtatgcaggtaatatcccaacacactatctgactgaacagatgcgtactgatgcaccggaacttaaagcattgcaccagcaattgcgtgatacggtggaaggtaagacaggcttcctgccaattaaatgtatcccaggtatcattgactgggtacaggaggaagagatggagaaattggttctcagtcacttcactcaacctaccaacagccgtattgttgcttacacaaatgaccaggttattaattacaataactacattcgtgaagctaacggttatgtgggtgaatactccatcggcgagcagctggtatctaactctgctgttcgcttgggtgtggataatcgtttatctattgaacaggacgtaaaactcattgaccaggatagtagtactcgcatgattaaggttacaggtgacctggaactggaagttcgtgatagtactcttgacctaggctatggtggcattgtaagtgaagttccaatacctactgacccagactacttcaaccgtttagttaagtggttaggtaaagaaaagaactgggaaccttacttccgtcttaaagaaaccattccagacctacgtgctactcatgcgtgtactgtccataaatcacaaggctctacttacgacacaatctttattgatgcaaatgacctctcaagctgtcgccaaccggatatggttgctcgtctgctttacgtcgctgtgtctcgtgctcgtaagcgtgtagtgttctatggcaatcttgccagtaagtacggtggcctaactttctaagggaggatatatgcctcagattggttcagcgactattggtcaagttgccaatagcagcgagatagtcaagcatctgttcttagcagaactggttcgtcttgatggtgtgttaaacggtatcattgataagaatgatcgtatcaatggtgtagatgtatcagctggattcctttaccagggtgagttctatcagcgttctaacgctaccagacctccaacctacggtgagcgattaacgcttaatccagaactgtggcctgcaatggacaagtatctgaaagcctccagtcgtttgattatggaagtacaccttgtgaaccagactgtatatcgtctggttcgcggttgtatgtcctatcaggatgtacgtgatgctctgcctgagtgtctggtagcacaagaccagacgggtcagtacaaaggtctgcctcgtactcgtgaagcagcctggacacttgctggtgatgctatggcaatcaagcagtatgagaagattctgccctctattgagtattatgcagcttcccatctgattttctaaggtaaagctatgcgttacatcacctctcaagatactggtaagtatcctattgctatcctcggtcatcaaatccgaagggaggagatgattaaaacctacctgctgccttatgacctaagcatggaagacttcatctttattgaacttcattctgcccctggcaagaagaagactcctgcaagggagattaaggagttcatacagcaggaattacagcaagtactggatgatgcagaaactcaatatattatctgtactgattctgactacttcaaaatactgactaaagaggctaaagcagaggctaacctcggctatgtttgtgattcagtatggggtaagcagaaggttatctatacgcctagctacaggcaagtcttttatgacccacctgtagtgagagccaagattgctcagggtatggatgcattgcttaaccacattcgtgggcagtatgctgaaccaggccagggaatcattgagtttgaagcatatccggatactccagaaaagattaaagcctggctagaccagttgcttgagatgaataagccattggctatagacatcgaagcattcggtttaaagcactataacgctggtataggaacaattacattctgttggagtaagacgcaaggcatagcctttaatgtggactacgagccaattcctggggctacagaagcaccatatgggcgtatcaacagaaatgatattgttcgaaaccttctgcgtgagttcttcattaagtacacccaacggcagatgtatcacaacattagctatgacgtgtacatacttatctatcagctgttcatggataacctgattgatacggaaggcttactgcacggcatggagatcatgctacgcaattgggactgtactaagttaattacctacttggctactaacagttgtgctggtaatcaccttagtctgaaagaccaggctcaggaatatgctggtaactatgctcaggatgatattaaagacatacgtcttatacccaatgagcaattgctacgctacaacctcattgatggattgtgtacttggtacacttatgagaagcactgggatactctcattgccgatgaccaactagatgtttacaacaacatctttaaaccagcctgtgaagacattattcagatgcagttaaccggtatgcccatgaatatggaaaccgttaaccaagtagctgaagaaatggaaactgacaggaaccaggctctgaaaactattcgtgagtctaacctcatgaagaactttaccctgatgcttcgtcaggaatgggtagacgataagaatgctaagttgaaaaagaaacaggtaacactggctgattgtaacatcgagtttaatcctaactctagtccacaactacagaagttgttatttgattatatcggcttaccggttcttggtcttactaagagcaagcaacctgctactgacggtgacactattaaagcactgcgtacacatacgcagagtgaagatgttaaggaactgctcaatgcacttatcgactataagcttgtggataagattatcactagctttataccagctttcaggaatgcccaaccgggaccagatggctggcactacctgttcggtaacctcaatctgggaggcacagtctccggtaggttatcggcttcagagccaaatctacaaacaactccatccggctctaaatatgccaagaagattaagaaatgcttcgaagctcctccaggctggatattttgcggcttggatttcgcctcgctggaagacagaatctctgcactgacgactaaagacccacagaagcttaaggtatataccgatggttatgacggtcatagtcttcgcgcatatgcttattttggtgagcagatgccagacattgaagacacagtagaatccattaactccattcagcataagtacaaatcattgcgtagtgactcgaaggctccaaccttcttacttacctatggtggtacttatatgggcttaatgaaaaactgtggcttctccgaagagaaggctaagactacagagaaacgttatcacgatctctatgtagttagtgatatgtgggttcaggctaagctagatgaagctgctaagactggttatgtaactgctgcatttggtttgagagtgcgtactcctttactggctcaggtattacgtgggacatgtaagactccatatgaagcagaagcagaaggcagaactgctggtaacgcattaggtcaaagctggtgtctactgaataaccgtgctggctcagagtttatgcgtaaagtcagaaccagtgagttcaggttagatatacgcccttgtattcacattcatgatgcccaatacttcatgattcgcgataacatggacaccttgcagtatacgaacaagcacttggttgaagccgttaactggcaggatcatcctgatattgctcatccagaagttggtttgggtggggaactatccttgttttacccaacgtgggctaatgagattgaaattccaaatcacgctaccccagaagaagttcatcaaataattcaaaaggcattcgcatgaccaaaagtactaaagaaactgtagtcaaaaagtatcattggatggtggcagcacaggtaatcttccagcttcctaaagctgatgatggctccctgcttaccatgaacacaatgctgctcactgacgaacctcatgtgacctataaagatttggctcgtgccaatcactcactgaagattagtctggatcagcgtttcgatacctcagttgatttgaaagatattgtttatctatctattaacaacctgggcctgatgtctgaaccagagttccaggcaaacatgattcccaagggggaataatgactaagctctccggtggtcttaataactactatgtagttacaattaagaatccccaacggaaagagcaagagccataccaagcagagtgtgaggatattatccaagcactaggcatgaccttcgatgaaggttgtgcctttaaagctctatggcgaaatgctgctgcccgtatgggtaatggtaaacctggaaacacttcagtttatgactgtgagaaattggttcattacgctaatcgtattcttactaaagagaagttagtagatgaattacctgccacagatatcactgctactgggagatgctggcattacccggggaatggaaagccttatctaacagtgaactttcagttcattgaggtagcgtacaaaggtgaactagataacatagtcagctatagcttcgatgaggtagagagtattcgttggaaccaggtgcatagatacaggattacttactgatgaagataaccaacaaccatgatgtctcgctggccctggctgtatggctattacatgacgagtatgattatgtagacaatcctaagtatctgtctgtaaccacactgcttaagccacttaagcaaatcgtcatgaagcatcgtgtagacctcagtgaccagtcaattgatgttatggattttgtctccacatcaatgggtactggcttacacgattctattgagaaagcctggaagttaggccataagactgcattgaaaaagttgggttatcctcagcgagtaattgatgcagtagtcattaacccaaccaaagcagactttgatgctaaccctgaccttatcccaatctacattgaacaacgtggaaccagggtagttaagggttggactatcggaggtaagttcgacatcgtaacagaaggtctattgcaagactttaagtctacctcaacctattcctgggttgctggttcccgtgatgatgaacacaagatgcaaggtagcttgtaccgttggattcacaacgacatcattaccgaggatgtaatccgtattaactacatcttcactgacttcatgaaacacatggctaatagcaatccgaactatcctgctaatcgtattatgcataaggatattccgttgttatctgtcgataagactgaacgttgggtagaagagaagatacatctcattgaaaagtactgggatgctcctgaagaggaaattcctgaatgtactgatgaagagttgtggcgaacagagccacaattcaaatacttctctgatgcttctaaggtagatatgcctggagccagaagtaccaaaaactttgacgatatggcatctgctcgtatcttcatggctgaaaaaggtggcaagggtgctatcaaggtcgtggaggggcaggttaagcgttgtttatactgccctgtcgcatccatttgcaaacaaagagagagatattttccatcatgagtattgaccttaccggagtagtgcatcatcaggcgattgaagaaatcgtagatgtgctctgcaataaaacccagaacaatgaccggggattcttccgtgtcgaagtagcctacttcttggctaaaatggcatcctgcatgggtgcaaccatcgtaactaaagaccgtggtgacctgccggtaaacatctacgctatagcgttggctacatctggtttcggtaaaggtcactcagtaaatatcatcgaagacgggttcatgtctggcttccgtaaacgctttatggaagacaccatgcccgtcatcgcaaatgatcgtctatggaagattgctaacgaacgttctgctcgtcagggtactgaccagcaggaagagtttgataaagttgaggcagagtataaacgtgcgggagcatatccatttacgtttgactcaggtactccaccagcagttaaacaactacgccataagctgttaatggctgggtgtggttcaatcaatcttcagattgatgaaattggttcaaatctgttggctaacatggatgtactaaccctgttcctggagttatatgaccaggggaaagtaaaacagaagctaaccaagaatactgctgaaagcgttcgtggtgaagaattggatggcaaaactccaactaacctgctgctatttggtacaccaagtaagctactggatggtggtcagactgaagaccagttctatggctttctagatataggatatgcacgtcgctgtctgtttgccactggtcacttagacaagagagcacatgcaacattaaccccggaagaaatctaccgtaacctgattaaacaagataacgtacagactcttggtaagtgggctaaccatttccatagtctggctgacccaaacctatttggttttaagatggttgtagaagataccgtgggtattgctctgattgcttacaaaattgattgtgagaagcaagcagaagctatggctgaccatgaagatattcgtaaagctgaaatttctcaccgttatttcaaagcacttaagctggcaggtgcactggcgtttgttgaccaaagttcattcattgagatgacccaccttaaacaagcaattctgcttgtagaagaatctggagcagcatttcagacaatcctcaatcgtgagaaggcttatgtgaagctggctaagtacattgcttctgtaggtaaagaagtaacccatgctgatttggtggagtctttgccattctataagagtggtaatgcagctcgtaatgagatgatgactcttgctacagcatggggttacaagcagcacatcatcattaagaagaccttcaatgaaggtattgagttcttccgtggtgaaactcttaaagagacagacatcaatgagatgattgtggcgtatagtgatagctttgcttatgactacattggtgaacgtgtaccgttcgaccagttgcatgtattaacccaagctcccggtatgcactgggtaaaccatcacatgaagaatgggcatcgttctgaagaaaatgttatcccaggatttaacatgattgttattgactgtgatggtggagtacccctgcatacgtgccatgaactaatgaaggaatataagttcatgacctataccaccaagcgtcatactgatgaagagaaccgcttccgtctgattattccaatgaactatgagttacacctcgacactgaggaatacaaagagttcatgaataacgttatggcttggctaccatttgaaacagatgagtctgctaaccaacgagccaagaagtggatgtcctgtgagactggttcctatcattacaatcttgatgcgaatctgttagatgtgcgtgactttattcctcgtactagtaagaacgagcagttccagaaccagatgaaggaagtacagtcgttggataatctggagcgttggttcgctagtcgtattgcctccggtaatcgtaataatcaaatgattaagtacgcactggcattggttgacagtggttgggacttttctcaagtacagcaagccgtccacacattcaataagaaactggctaatccattaccagatgatgaattgaatgcaaccgtaatggtcaccgtggctaaacgctacgctggcaaataagtaaacaggagtctttctttggtttgaaggactcctaaattaaacgaggaaaaataatgtccgaagaaatctccaatgatatgaacactcagctaatcctgattgcaggattctcagcgagtggtaaatcagcatcactgcgtaacatcaggaaccaggaacgctggctctatctgaatactgaagcaggtaaacgtctacctttccgtaacaagtttaatacctacaacattgaagacccatatcagatttgggaagcatttgatgttgcatccccaggtggtgaaatggcagacgatgttgatggaatcattatcgactctgctaccttcatgatggatatgctggaatctcagtatgtactgccatctgctaatactcagaaggcatggggagattttgcacagttctttaaaatactgctgcaacagaaagttgttaaatttggtaagccagtaattattactgcccatgccaaagatgaactcgacgaagctgctggtgtgattaaaacattcatcccagtgaaaggttctctgaagaacaatggtcttgaggcttacttctctacagtggtttacgcagagcgtgtagacattaaagagctggagaagtatggcaacaagatgcttgaaattaccgaagaagaacgtgacttaggttataagcacgtattccagactcgcccaaccaagaagtctgttggtaaacgtctacgttccccaatgggtatgttcgataagtctgagacttacattgataatgatgcccagaaactcttagaccatctggctgaatactacgcttaagcgtttgcctggttgttaatcacttattaggaaaaatattatgtcactgttcagtaacttgaaagaaaaaaccaaaaacgttgaagctgtaaaagactcccttggtggtggtggcttcggtgcaaaggagtcagatatctacaccggtactgtaaaagtagcttacgtaggtaaagctgactctggtgcagactggatgcagttaatcattgaaaacctgaaaggttctgatggtaatgatgctggcgagttccgttcacaggtgtacttcacttctggtaattctaaaggcaataagcctacttacgagaagaacggtaaagaatacttcctgccgggatacaccgtcattaacgacatgatgctgatggctaccggtacggaactgcctgaagctgacttcgaagagaagattgttaaagtctatgacttcgatgctaaagcagaagttaataaatctgtcatggttccagtagacctggttggtcagactgttaccttcgccctggaaaaggttctggaatctaagcaggttaagggtgacaacggttacgttgattccggtgaaacccgtgaagtaaacgagattcagaaagtgtttcacccggaactgctggtcacagtcgtcgaggctcaggaagcagagaaggctgagaaagaactgaccccagaactggctgtattttatgcagcatggttagaaaagaacaagggtaaaacccgtgataagaccaagggttctgctggtggtaatggcaaaggtggcttgcctcctaaaccaagtgctggcacgggtactgctcctgctggtggtaaatcactgttcggtaaacgttaatgaaaatcccaattgttggtgcagacattagtctccgcaattggggtttagctcgtgggatgctggacattgagtccggcgtcttcgagcaggtcgaacttaaactggttcaaactgaagttgaccacaacaaacaagttcgaaccaactccaaagatatacaagccgctcacgatttgtttcttggttgtgaagaatggttacggtctgctaaagcagtattcgtagaagtaccagtaggctctcagtctgctaacggtatgaaatcctatggcgtatgcgtaggattaattggtgcatttcgtgcattgggttgtccaatctttgaagtatccccaattgaaaataaacttgcactggtcggtgataaaactgcatccaaagacacgatgattcgtgctgcccatgctatctatccagaagccaactggctcacagataaaaaaggtaaacttctgaataagaatgagcacttagcagatgcaatcggtgcaatccacgctggtgtaaatctcccagctttccaaaaccttcttaatttaataaaggcgtaatatgcaaatcattttgaaccagtccgaagtagaagctgctgtacaggcttatgtcgatgatcaaatcaatcttgctggagacattagtattgtcatcaatgcagatggtacagcctccgttggtattaacgaagaggtaagtcataacgatgatactccacccttggtagagaagaagacacgtcgttctcgtaagaaccctcaggaagctaaacaccgtccggtagaaccggaaccagaagaagtggttgaagaggtaaagggagaagaaacccagacctctactggtggtccgaacaagagttctacgccggaacctgaagaagaagcagtaactgaaccagaagcacaagaagaagttgtgcaggaagaggttaaggctgaagaaccagcagagaaacctgctactaagccttcactgttcgctggccttaaacgtagttaatctggtaggtggctcagaagctgctgctaggtgtggtagtgtttatagtcctgatgctactactggtcaggattatagacgtgtcggctccatacatagcttttatcatcactgtcattatcctgtggaaatgcagtggtaaacacggtggtgacaagccgccagagtaacaacaaccgaaccagtcccctttaatactctccgaaggggattggttcaaacagggttaacatgaacaaatttactattcactggctcaatggaaaggttagttctttcatgggtggagaacctgctgaaggaaaaaaaagcattccacattgactcagaaggctgcaaaatcttaataccgtatgcttggtataaagatggtgaagtagaagcattgaagaagagcagttaatatcgtgaagggttctgttagaatcctttgagataggaactcctatcataacctttcttaacttaatctttgccgtatggcactgacgctaggggtggccccccatccgtcagacagactattttaagaatcggttatcacagaaaatgtaaagcaacattcgggttaatcaatggcctcttcctataggggccatttctgaatcttaggctatatcccaaaggttagtatctttaggataaggcttcagatcccttatcaaactaaccgctcaatgttgagcattctaatcacataagcccctatatgggctgggttaaatgtcggatagcctagctacctacaacatcgaactgttagatcttacatgcaatatagggtataaagggaggattcgtcccctcccccctattatgggctatcggtgagtgcattagttgattagctgtggaaggtaggccgatgtccacaagcgtggcccagagctagtgtactctccgatagttttcgtaagcgattatgcggttttttagaaacgaaccaataacataagtgcaaacgaagaagcgtatctgatggcagcttaataagccaagcgtcagtcaggagtgagtcgtcctgattatcaaacgaccgtggagttctcccgtccatgtattagaaacgggggactaattatcagttgcacgagatggcttgacatgttcaagtttggactaagtgtgacaccgctagattggagggctgctgcggtaagctatagactccaaccggaggttcgaatccttcactgataaccaattcaaagtagcattgtatatttaaatgtttcccggcatttaaagcacccaccgtgacagtgctactctaaattggaagaattatgggggtaagtcgtaaccatacgacggcgtaagtaccagatgagacttctggacgcccctaccatatttgaggtgtaacagttaaatccagttgccggaagtgcaattctagatacgctgccaatgtgtgaacggtaaggctgtacaggactcggactcccacctcaaaccaaagtcgccaggtacttatggcaaacgggtagtaacgaactagtcattcgtcaaacgcccaacccaattatgagtcagcaagaacgccttcacttaaatttaaacaaaaaagcttaacgcaataattatgtaggggtatgtaaggattgcgaagaaggagccagttagagtctggcatgactcacctattaatacccggtaggcttagtggtaaagccccactagtaaaccaactaggacgcaggttcgaatcctgtccgggtaaccatattatgtccgcttagcttagactgggaaagcaaccgactaataatcggaaagtcactggttcaaatccagtagtggacacccatttagcagtaacatagtcctgattgcatcgcactctaaagacaacactggtaagacagtccagtggctgctattgtattgttattcccttcgacgggaatttcgctggagaatgggaactccttaaatcctagcctgagtaattaccacaggaacgggactatcaatcccaagcctggtcagcgtggactgtcttcgtggtaagaaccaaaagcctcccagctatgggtaaatagtactaagtcccctggagccgtcactctgggggacttttttatttgagtattaataattggataatcaatatgattgacctaatctcaaccccgtatgcctatgaggtaacggataatcgaggacgcaagtctttggtgtttgcaggtagcgtagcctataacaacgcagtcatgtttaagtacaaactcaaaccactctatgaggctaataatggcaacagtaagtaaagaagcaatcgaagctaagattaagagcgtctactattttaatggagctgatgcagtgaagtctgcatttgttgatccatctgcactcccggcagatgatttggctaacctgggtctgataacctattgcattatcatcttggaaaatggcttcaaagttgaaggtgtatctgcctgtgttgacccagctatctatgatgagcaaaaaggccgtcagtatgcatatgaaaatgcattcaataagatttgggaattagaaggttacctgctacgtcaggcactgcatgagaaagaagagactgctaaagctctggcttcctttgcagaaaacaacacctgtgatggtggtggttgtacaatctgattcaaaagtgtaaggtagtttttaccgaaaggtactgaactacccgacatgtggtaaggctcatgaagccaaaacaaaacaagccctcctagtgagggctttctcatttgaggtagttatgtcagaagaaattaaagtccattttaccaattatatcggaaccaagtgtgtaaatggtttccgaatgaacaaagaaacatactgcaaacttcgtggctgggatgtacctgctaatgaagacccattagaagaaggttacttagtagagtacccagactctaagtctaaccatcctcagttccgtggctatattagctggtcacctaaatctgcatttgaaactgcgtaccatgacgtagaaaaaggttgcacctttggtcatgcagtagagcttctcaaatccggcttcaaactagcacgtaaaggctggaatggtaaaggaatgtacattgagtacgttgctgctcaagaatggaatagcagtagcttagagcgtacaggacttgctgatgaattgaaacctcgtccatggttaggaatcaaaactgttgatgaccagtttatgccttgggtcccatcccaatcagatatattagctgaagactgggtgttagtttagtaaaaattaaagcccctctaatgaggggctttttcatttagttagctagattgagccaagggttaaggttatgggcacgaagtccctgaccgaagccccaggagtaaccgagattgccttgtgcagcaatactgaagatgttgtcctgaataggtaaaccaacattaccaaacatggtaggagttggagccaacatagccatagctgcgtgtaccgggttgttacgaatcatggatactgcaatttttgcagaacgaatcttaaagttatagaaccacataagaccaacactttccatatacccacggaagcgaccaggcagacggtcatagttaatgaactcttccgttacacgtccaagtgcttcttcacgagtcttacctttacgctgagtcaaatcatcatagatgattgctttagcaataaagtcagagtactcaaccgtcttctggataccctggaataaagcagtatccttggtgataagggcataacgtccagcattacgtacagacttaggtaacttatcagccagtttatccatgtattcgtgaagtttaccttcagtaatcaggatgtcatctcgtccaataccagcatctgcaattgaagaaaactcaccagcttctaacagaggccagatactcatacgcttatgactatcagtgatggactgaatttcagccttaagcttacgaatctggttcgggttagtagctgcacgtaactctgcttctgcatctacctgacgcagacgagatttcaggtactggttaatctcagcagtcttctgtggaatgctcttagcaatgttcttaacaggtacaccacgaccaaccatctggtaaaggttagccaggaagttaacagcaggaacaactactgatttaactacaatcagagtcttagcttctttaactaagttttgaaccaggttctcaccacccattacatacttataagcacggttgccgaatacacccaacatagctttcttgaaggtatccagtgtttctggtgaccaacgagaattgccagaccaggcatcacctacggaagctgcacgatagcccagtgcatcattcagcatgtcacgacgtacccacaactcaccaggaccaaacagactttctgctttctgacgagtttcactgttcatcagcttaagggcatcagcagttactgggtccagtttagaaccaagaaggttaacgtactgtgacttgttagaggcagacattttaatgtcgttttcatacatgctatgcaggttctcaatcagcatatcattgaaacgctgagccttagcttcctctacctgacgaccacgccatacaccaattgcacgagcaagatggttctcaccctcaatgtgcttcagcatgttagggtcaatagattgctcatatgcaactacattacctttgtcatcatatacaggcagcagtggttcattaccacgctcaccacgagccagtgctttagtgatgcggtctacggaaggcttgtcagtgatacgaccagctaccatagaacctatcgtaaagcctgtaccaaggtctacaccgccagcagtattgcgaacgttctgtagaataccttgtgagaatggagcctgtgcctgtacaggtgcgaagtagtaactacgtgctggaccacgactagcagagctaccctgataagtacccagacgtacataagacttctcaatcaaatcagcaaactgactatcttcagcaacaatcaggttaacaccctgtttagtctcaccaggaatgtaacctttatactggttcagggttgcacgcatgtcagatttggctttagccatttcatctttacgctgtccaaccagataagaagtagcaaaatcaatcccatcagcttctgattgagccagtgaagataacatctcacggtcagtcttactcattgcttccagtgcatacagagtaatcagtttatccagttgagctacatctacagtagaacgtgcagcctgtcgttcacccagcatacgagagattgcagtagcattacgcagcaagttattaccaactgtgccattaatcatgtactgagccagttgcttagatttacggctaatcaaaggccagttacgtcctgcttgtttctgcaaatctgcttccagcttattcacttcacggtcaacaatcttttggtcagtcagcaagtcacgaatttcacccagagacatagtgtcacgcagaacagctaagtcggttttacccataccggtatgcattgctttccactcatcattagtaagcttacggctgaacttagatgcaatagtggtaggcaaatgttcacggaactgctgacggtcagcctgtacctgtgcacgcactgctttaatcaaatcatatacagaagcattgctcttagtacgaccagttaagtcattaaccaggtcatggaaaggttgccataccttaccctggttcattgcagccataacaccctcagctacgattgcaccatttttctctgtagcaatagcagctattagttgtgcagcatgagcagcacctttaaccaacgggttcttggtattagctgcaacttcacgagcaccctctaaagcacgggtagacagtacatcaatagaatccaccagatactggttagcacggtcgatagcattaccactaggagtagcaatggaatcatagaaggactgtgcattgagactcgtctgcatgattgtctgagccagtgcatccataccttcctgtacgttggtagctttagtatctcctgctacacgagcattcagactagccattgcagcagtaccgatgttagtcagcattgcatcagcggtattgccagatttcttgtctactttcataacaggaatgtcagccagtactttacgcacttcttcacttaccattgccagaccaacaaaggtaggcagtaaggaagaacggccttgtgcatcaaactcaatgttgttagcacccatgatggtatcgaacttctgctgtgcatagtaacggtcagcagggttagtactatctgggtcagccatgaatgactcaacggtcaggttcttagtaacatgtgtgtagtattcctgtgcacgagccagagcagcaggattaatagcagcttcagtagccagtgcagcaacaatgttagtaaagagacgttgttcctgcatattcatagtgaagccatgagcctgaacatcacgagttactttagtcgcattaaccactgcatcagagaacttacctttacgaattacttgctgtactggttcagaaccaatgtagtctgtaatcagtttatcaaaggttttccctagctcttccagacgagtattgtcaccatatgctttgttatggaacaaagtagtatctttggctacagcagcagtaggtgcttgaccacgcataactacagcagagttaaacagtaagcctgagaacatatcatctgcattagccggagctttcttacgcccgaataccagacgtttgattgcttcatatacagcctgaaccatggttttcagtgcagtggttttcttctgcttgctaatcaattcacggttggttaaaccccaagccatgtactcgttaagtgcagcagctttagccattgctggttcaatgaagccattagacaaatgaccattaatggtattaagagcatctgcatatgcttcacgtactgcaggagtttcatccttaacatccagagtgcggaactggttcatcaggtcttcaatgttctgaactgcttcattaggagtaccttcatagtgagctagtacagattcaaaagtagaagcatgcaccaattcatgaaccagagtctctaaggaaggagtaactaagtagatggtcttatcttcaaagttagtccaaccgtatgcattacctgcttcagcagcttcaatatcttcaggtgctgggcgagtaatgttcttctcaatagcgtaagcatccagttgaaaaggggttccatagacaaccttgtagtctttagcagcaagagatttctgtacttctttcaatactgcttgctgttccggagacatctctttagccagcttagagatagcagtattagatagtagacgtacaccagacttcagtactcgaccaacctgttccattgccggtgcttctttcactggttctgttttagcagcacgtactgcatcacgacgcttgtttaactcagcatcaaacagttcgttcagcttagctacttgctggtctacagtcagaccttccagagagattttaccgttgttcacataaggagcaccaacagcagccatctggtcaacagtagtctgtacctggttcattactttgtgacgaatatctacacccagagcaatattacgcaggttacgttcaatctgttcagcaccaacacgtaacaggtcatcggtagctccttcacgctggtcatattccagagcagatttagcgatagcctgtttggtttcatcagacagtttgctgaagtctacactcttcatgaacttagcgaaggagtcataaacattcttgatagggttaccctgccaggaagtgtatacagcctcattagctttacgacttgcatcagtgatgttgttgataccaatgttcataccatcaaagattttcagggtattcttcggagcacctttcatagtagaaagggtctgcatcatcatgccatcgccagtaccaatggtcataaaaggaatacctgcaacacctgcctgtgaaggagcatagatgctcattggcacacgcatacggtcatctaagttggtagccagtacttggttagcaacatcagtgttttcactaccggcaatgtagaaagtctgtgaaccagtctcaatcattggagctagtggggataatgattcctggatttcattcagttctttctgtgttaagaaatcacccttcttccaggttgggtctttttctttttctgccagcttagcctgtactgcttgttggaacatgtcttgtagaaccaaagactgaatctgggtagccttctgcaagttctcagtagaatgcatcagaccttccccaacagtattccggataccagtacgcattggttcaacgaacaggtgaagcatgttctcttgtaagttcttcagggcattacccgatatggtaaacttctgagggtctaacttaccagtcagagcaccttctacctgttgaatagacaattcacctttacgcataactggaacattaccagtcagtgcttccatagaagtaaggaaagtatccagcatagcctgagcatcagcctcagacgcagcctccttaccaaacattgccatagctggggaaatactagggtcagcagcacgagcttgcagaacatcactgaagcgttcatagatggtatcagtaattgcactaaccatcttgccagcaataccacgagcacctgaaccatagatggtaatggtcagtgggtttttagcgataccacgtttcaggtccagagtaccgtcttcattcaggttaaagtctttaataaacaggtccattaacttctgaagatgattcatttggttcataaccggaacgttgttacggtaagtagtacgtaactcattaagtgcttgttgcagaccattggtagatgcttcatacaggtcaacactgtcatcctgtgaacgatgttcattcatagtcttaccagctttaccgaagaacagaccacctttagcagtattcttaatccagtctgaagtgaacttaccaccagtcattaataccattgcgttgattggtccgttggttacaccatcggcttcaacgtacagtggggtattaaagttggcacggtcatcactgttcaggtaacgggcatattccataagagccatgagagctacgaatgatttatcgccacccaaagaagtcttcagaatatctactgcatcagctggtaagtggccagacttatcaaactcaaccatcatatcaacagcaggtttcagattaccttccagagctttggtcagcttttcagacatagcttcacgggacatattatgtaccttgatacccaatgcctgagccagtcctagctggaagtcagagaatgtttggctgttttcattactcaagtcaatagtagagaaggttggcagaattgcttcacgaaccagtttactggattgtgggttgttcttacctaacatctgcatacgacctacacgggtcatgttgtaaccatagtgaataggcgtatccagaccattctcctgttcctgtaactggttgattacaccgaacagggaatcatatgccatagacactgacaggtttttaccctccagtgacttagcagtgttcacgttcagcagttcaggattaagagtaccagcacccatcagttccagaatgttgtcacgacctaatgcttcatagaagttaaccatcggcatgtgtacacggaactcggtagcctgttctgctttaagagcagctttctgctctggggtattcttaacagcagggttacgtaactgagtttgagccacggaaggaatatcatcaccaaagtacattttctcttctggttctacgagaacagcttcctcgatagcagtaggaaacttgttaatggcatcgttatcatccagcttctcaatggtatacagaccgacggtcttattagagtctgggtcaatctcagacacatcaagcatagactctttaacttcacccatctcaatgagagaagacagaatctctgtagccattgccattggaatacctttggtataacccagtggtgcattaggattacgattcaatccccagtaagattcaatcttttgagccagtgagttagtagcttcaaccagagtctgagcattctcaaattcagccaggataccttcaggtaacaaggatgcttctactccagtaatagcagctacatctttcatgtctttaacagcagcattctgtgtagcagtcagtcgccattgcagaccagcaagtacagcagtctctaacaactggtcattgaacttaaaggtgtctccgtctttctctacgatattaagtaacttaccacctacccaacggttagcctctgtgccttctgcaaagcgtttaccaacgttcttattagcaagaaacttagccagacgatcagacagagtagtcttcagagtttcaccaaagcccattaagtcctgataacgcttaatcacatcacttgtgagagcgttattttctttttgagtgaatgcttcaaagcgtgcagtagaagacagtgcttgcttaatatcagtcaaaggggattcagaaccaatggtgcgagacttaggttcttccggcagggtaaatgatttcaggaactggttcggtgtcttgtcattgttatagacagggaaaactgtttccattttcgttttagtttcagctactttttgagtggtatcctcattggtgagggtagcatctactgtttcagacttagtagtagagacttcttctgcttttgaactagcctctttaacaggaacagtcttattttctaccactggtttagctttaggctgtacagtagtagtagtctcttgcgctggtgcaggagtttcatcaacctgattcactggttcattggtctgttgagactgagtggcatcaagaccaccttgacggaactctttaactacctgggcagcaggcttgtccagacgtgaatctaatggagtaaccttcacatgagaaacattaagctccgggtaagccgtagcaagtgcgttagcaatatcagctacggttttggcctccagtcctacttgctgggcaaacttaaccgacttggtatcatacggattgacaccaagaccagtacgactacgtacccattcacgggagggagtaagagcctgataatggacagacttattcttatccgcattcccagaaatcagatgctcattcaacgctccgaccttattctgcatgtgctgggcgaacttcataaagtcgtcgaggtaagcggaagccaaatcgaagttaccagagttgtacgcagaacgaatgcgtttagcatgttgcaacgcagagtactgaccttcattagaacgagactcgtcggttttaatctgtttactaacaatgtcttgaggacgtaagcctagttcttctgctttagcgtcaaattctcgtgctccttgcaatagagcagcagcagattgcagggcagcacgctgatgattccccagtgtaatcttaccttcacttgcatgtttcagaaccatgttcactgagtctgcatccagtacttctggagacatatcagcagccatagcaatgttgtttgcttgggcttggttagcttcttcggtagctttcagtttacctgcttcagcctgttcctgaatcatagaatggatggcacggaatgcacgaagtacctttggtgtattctgaacgttagccatcaggccggagaactggtcaacaatattagcagcaggagaaccctgttccagattagctaaagcaccaggatcacggttaatgaagctatccatagacatgatgttgtcatacatctggattgcagcttccatttgaacgttagggtcttcggcagtattaaccaggtcagccatcttctgaatagcttcaacacggttagtggaaccagaaacagcttcacggattgctgggttagcttgttccagttctactgggtcaaatttcattgcctgagttaagtcagcagcatactgagtagcagcagctttctcttcaggagaaatatccattgcatctactgcttcttgtacagttgcttgtgcttgttctgcttgagcagtagcttcttgtgcagcagcattaaccgtagcatcagatacaggggaagcttgttcattacgcttagcaacttcttcgccacgctgaaccaggatgttagtaataggagaggcagcttttgctaatgcactaccaaccagagaagcaccagccagagtagtacgtaaagcaggcccagcagaagcaccaacagctttaacagttgtacctggagcctgagcaacaccagcactaccgaagccgtagagtgcaccaagacctgcttgctcaccgacacctttaagcaaatcacgcttagcatctacattaccctgaattgccttgttctgtgcaaactgacttgtaccagactgaataccttcttctactgtttcacgtagcatgttagaaccagcaccagccagcgaacctaccttaagtgggttaagttcaaatttggataccagaggaccagtagcagcagcaaccggagcagttaagccagcagcaatgatacccgtttcagatgcagtttggcgacgtgcttcatcaggagataaaccatcagcgatatgctgttgataaacaggagacttacttgccaattcttgatgggacatcttcatgatttcggaagcagtctgttggtatgcaccaccagcttccataccaccaattgcaatagcaggtgcagcaacacgaccagcagacaatgcaacctgtgcaggacgtgaacctaactcagcagctaaggtaatacccttaacagctttatcaccacctaccattactttaccgagtgcagatacaccacgaattaatggaccaccggtaaagagagaaccaacaccttcactcagcccatcagtagcagccataccattatcaagcgtattagcaacagaatcaaaagcatcacgaccaatacgagacagagaggcaaccaaactgctctctccatttttaatgtcttcttcgtagagtttctggttcttttgtgcagaaatctggttctgattctgaacaaccttacgggtagcattcagagcatcagactgtagattgtgtaccccttcattcagccaatccataccggaagcaatggatgccccggcattatcattgaccagacctgtgccaagagcagcaatgcccccaagggtattagcaacaccaagaccaacaccagaaagagtatcaccaaatgcttctgcgttagtacgttgtttagataagtcctgacgtacagcatcagcagcattagcccggctattaagaatctgtagaccttgctcattaccgtatttattaagaatttctaatggggaggcttgagtgaaatctgcctgaagtgaacctggttcgaatgcaccgattccaagattacctacacgaccagtttggagattgtaagcattctctggggttaattggaaagggctttgcccttgtgcagcttgcttctgagaggttgcagtagagacatcgacttgcttagcattagtgatgctgtctgcgaaacctgccagacggtcaaatgttgacatagcatgtttcctgttcaaacttatatcgtatatagaaagcttactctacagtaagccagtgtaagaaaaaagccccgaagggcttttgttagtattaccgattttgtcttggttgcatatactcaggcaaaccctgtgcctgacgtaaataccgtgcagcacgttcttcatcttccttggctcgtgctctgtccacactagcctgtgaccggaaacctcttggagccaggttagatgggtctgcttgaacttgtgcttgagcagcttgtagcattgcagcagctttagtaacagcttcctgacgagcaggcaacaatgcagtaagtcctgtttgtccggtgttaatcttgttctgggtatttgtcagtgcagctacagcagcatcataagcagtctgtgctgcctgaatattctgcatggcttgagcacgaccaaggttacgcacactgccttccagtggttcaccacgttgtacaccctcaattaactgatctaccagacggtcattaagacgcataccattaccagcttcattggtaatgaatgggttaaccgcatcaatagcacggctaatgtaaccttcaggtacaccagtctgtgcacgttgcataacagcagcagccatagctggagacatattcccacgttgagaaatatcagttaatcggttaagtacccagttacggtcagcacccttaaagtcaccatccagtagacgattagcaatctcacctactggagtattatcggtgacagtacccaggaaatcggtattaaggctaccggtattatcctgcatagagcgagtaccaatcataccctgagccaaggtagatactgcctgatttccctgattattctgaagcagagagaatgggtcagcccctacttcagcttgggcaataacaggtttaatctgttcccaagtcatatccttataagcacctggggtagagttaggtaaagcagcccaggtatctttaaggttaccattcttacgagcctcaaaaatagccctaccaatcttctcctggttctcaggggaaagaggttggttctgccaatctgaaccaagaactttgggggcaaagtctttcaaggtagcttggttaatctgaaatgcaccaacaggagaagcaccctggttcgacttcataccatcctgatgcttgattacatcaccgatactcatttgagtaataggagtggaagtaccagcaaactggtaagtaacatcataaggggaaccctgtcgagtaccagcagtaccaggagcagatgtagtacctacgccattaccgtatacacctgggtaagcattagccagtaatccttgcaaacgtgcctgagcaaccggagacaggttcctgctatatgcctctgccaacagacgtgcatcattgggattctcagcaccccgggtaatctgtgacattacacccatagctgcctgactatcagcatcattacgctgagacacacccaaatcaaaacggttctgtgcttggttaatagcctgaccaccttgaccttgaagacgtcccatcatctccagttgctggtcagcagggagtgcagatagtgcctcacgggtctgccccaatgcagcattaatacggttctggtcaccagactggtaggcctcggacagtaaacgaatagctggggaagcactatctaatgcagcatttgtatcctgtaaacgaccaaagagataagcattatagtcattggttccctgctgaccttgttgagtcagaagagtacctgctcgctcatccagattctgtagagtacgctggtttaccagtgaagggtcaaccccctgaaacagtgcaccagatgccaaagcattacgatactcagtagggtcttgatactgcatagcattcatcatgacggcattgccagcctcctgcttggcagcgttctggaaattacccagtgcatcacttaagccggaggtggcgttacctatcatgctaccaaatgtgcgaatgctgtcaccaactccagagaagttaggtgcatcaacattacgccatgtaatttgagccatgatggtttcctattaacgggttaatttattagctgcaatataagcatcagcagtagactggtcacggttctctgctgtagcacggctacgagcacgatcttccagtgcagtgttataagacttaatctggttattcaggttagtgttagtaacactcttagtaaagttcaactggtctttggctaacttattagcctggaaaccactgtagatattagctaatgaaccaagtgcacccagtcctaattggaaggtaggtacattcaatcccaactgatcagctgaaccagacaggaaagaagcagggtaggctactcctgtatttgcccccataccaatagttgcacctgggttatagttcatagccggggtattaaagttctgattgttattagacatccaagacatagcagctggctgtggagttgggttgcctgttaagaatgacaaatccatggggattctcctgttaaacaaggtcagtattaagagtcatatcagagtagttgccaaccatgtctaaagacaagtcagctatatctgaaccagtcatgagagtacgtgacaagaatgaatccaacgactccattgacacgaattgcatggggtcaatcacaccctgtccagcagtaccgaacatctcttcatactgcttattgattgccatcatatcagtattgtactgctgcattacactctctgctttctgaatagtagcagccgtggatgcattaatatactgactaatgccattacccactgaactggtaagttgcatgatgttttgagcactcatcatttcaccagctaaagaggataaggatgtaccagtagacaaagcagtaccaacgttcatggctaccattgaggcaatagcagcaatgataaaacctagcttatcaccgaacagtgaagtagatactttagtaataatggataccagaatcattgcagctatggcgtttgctacagcaccaactattacagcagctaatccaacaaaaccaagtgatgcaccgactgcaccgtatgccccaagtatacctgcaccaccagcacctgctgtaaatacagagacaactacagctaccactacaacaacaattttaaatgccccagtctgataccacttctgcttaaccttcttatatgagttcatcactaagtaggagcaggcagtggataactgagtgctacgaaccagtgacattgaacggtagatattggtgtgcagtggaataatgaatccactctcctctgcatcacccattgcttcggcaacatcaatgtgcactgacttatttttatataccctgttgttgtgatttagacccagtactctaagtttacgataggtattattaccatcctgccaaagcaactcgtattcctgcattgaatagaatgtgtatgttacctcaagtttcttagcagaaccggagttggaagctgtccttatgttcttacgagtaagggttatatctcctgcatacctggctcgaagttgcccctgcttagcaccagaccatgcttgacctgaatgggtagtttcagatacatagttccagccaatagtcatgtcgtacttgtactgcttattactatgcaccctaaactctcgcttaggtataactgggtattctggcagtggtggaggtgttccaataatatgcccttcagtcctgttccaccattccacatatgtgtcaactgcatcatttgctgcctgatagcctgcaatcactgcttccagtgttgggtaggttgggtcaggtgggaatgcttcagtagccatctgaaagaaacgatagatgtattccttagcactatcctcgggggtattaagggatacaccaaatgaaccatagatgtactgaatatcacctatgtcatcattcttcttaagctctgtgactactttatcaatttttccaccagtagctttataaagggctttcttacagtgtgggtagattgggtcattctctacccattgcttatcatttctgattggaatgaatgggtagaatcggttatcagtagcttcagtctcgaacaaagaatctagtgcaacgttaccggagttctgcttataaataagcattttaggtgtactaacagcagtcatctcggtatcagtacgggtagtctgggatgagtacttacgaaccagtgtctctgtggttgtagtgattgtatctgtacgagtaacacctccacctatatcaaccacattagtagttacagaagtactggattgaatctcaccaaattttgtatgagtcattaccctgtcagatacaactacagtcacatcatcaggtttctcagtgaatcctctacgataaactttaacgtaagagttccagttatccacacttggttctgtgacagtactgtcttcatccggtctgccatcagagtaaacagaatgagtatgtatagtcttagtaagattggttgtgttagccgtcgtatcacttgagacggtagtccataacaaagtggaaggtaagtcatcctcatcatcatagacagtagtcggtcctactaccggaggattagtagaaggggacttatagaatgagtaatcagcatagagatataaagcacctggttcaaagttagtaggtgtgaatgtaatagtagagcctccatctaaggaggtcatagtgatttcattagtatcttcatcaatatctatgtcgaatcgttccatgattcgacttggagcattctcataaagatactggtcacaccattgctcaaagtcagcaaagccaatctctgctgcctgaacatagactgattcaccagcagggggtgtaatttgaccctctataacggtagggtcaatcttagccaatacacccaatgaagaaccagccataccaactactgaatcatagtggttcttactccagctggagaacagtcgcatacgaatacctggcccattcagataactatcagagatagtatctgccatagtgaatcctgtattggaaacaatattacctataactacagtcttcatatagttagggcgtttatgtatatcccctgccatgttatagacagaggatgctacgtatactttggtcttcccactgaataagcccatattagttcagcccgttgttagacttcagcttggtcagaatggtgtcaatacttgcgttagtgaaaccatttggtggattcaagccttcatcaatagtcttctgagtaatccatgcatcagtaaacagcttagatgctttaacctctgcatcacgttgataagaagtaatctgttgtgagtacaactctttctgtttacctacagaaccagtaacagtagctccatcactacgggtatcaagtgtctgtgcacgttgtgcttcagtctgctcagtaagcaatttaagctgttgaggtaacatctgactaacattaaacaatgcagcacagtatgtttcagactcagtagcaatcttcatcttagtaagagcatactcactcttagcagacagtgcctgaatcttagccagcacaaactgtgctttaaacgttgccagttgaacacgagcagtaactgcctgaatctgtgccatagcagcagcccagtatgcctggtcacgaccaagtaagaactgaacagcattgctcatgcaagattccatcatagcaatgtatgctttggtatattcaccaccggtaatacggttagctttaaactcagctttcagatgattgtgtgcagattccattaatgcatcaaacgtaccactaccaccaacttcacgggtagtgagtgattcattggatattttatcaatagcaccaaagattggggaagcatccccaccagggatatcccattcggggccagtcatatcaacatcaggaagggtaaagtcatcacccttagttaactcttctaggagtcggttagcttctacctcagcagaacaagacataatcattcctcttggttcaaaaagaaacggcccacggagttaccccagtgagccgtgttgaactgtagcttatacgttaatcgttcaggctaccagcagcaatctgtgcctgagctagttgagctaattcagcttcagtcaacggaggcagtacctcaatggagaactctcgtgcttcagttgcacgaatatccggtaagccattcttacctttacgggtcgtaatgttgatgaacttacgctctttaaggaactcgtagatacaatacggaatgtgataaccattgtcggttacttcaccgaatggaacaaacttacgcacagtacccatatattcgttagctacggtgataatctcacctggcaggtctttcttcttagggtcaaggttctggatacgtacacgaatcagtcgagtctgttctgcacgaatcttttgaccaagagtcatcttcttaacaccagcttcctgtttttcacccagcggattaacggcagcttcttctactactggttcatcttttacttgtgcagcttcaatcttctcacgaagcttttcaacggaaatgttgttagagaacttgatattcatcaacgttgcacgttgcttaagaacttcaagttcgctaggcattgcaatatcgttaacggtatcttcgttgccctgtacgttcacttctacgtcagtggtcggtttatcgttaatgctcatgttcatatttcctgtggttcattcagttttattaagagggggacattagtcccccttgttttatttcggactattacagaggagcaacagtcttaatcatagccagacgttctgggcgtttaaccaggataccgtagtaccacttgatagaactgaagccagtttcaccatacgggtcattacggtcagcagtttctttaccaggcatcttagtcatgatggagaacttaacagacttaccatcagtctggaagccaatggtagagaaggagtcatcaccaactaccagcatcgggaatacgtcgtagtgttcctgaccaccaaccatagtagaacgatagcctgggttagaagtagcctgagcaccagcacctgcccaatgcagcatctcaggaacctggataatacggaacttgtcgatacaaccaacttcaccattcatcagagtaccggcatcagcatagtgctgaatttcgatgaatgctttgttaccgaacagatctttcatcgctttcagttctggaaccaattcagaaccaacgtacattacacgagtaccaccaagtactttggtatcagtcagtttagaaccagtgataatagtagtctgagtcggggtacggttctcagtaagaatctggtcaagacgcatcaggttcttataagaaactacagacggagtagaaccttcaccggtgatggtagcatcagaagtagcagcacctgcatacaatacagtaccagcagcagcaagcaggtctttctggagaacagcttcagtcagctgtacagcaccgttcatcaattcgcgagacaggtgttctttcagttgatcatcagaatcgaagtccagggactcttgggtaaattcgtagaagaaaccgaacttatggatggagccttcacgagacagacgggtaaagcctacacggttaacacgaccaccgttctctgtcagcagaggcagtttggaagtgatgttaccaacgtctttagaagaaccatacaggttaccattaacgatggtagcaccattagcatcaataccctggtcgttaatgttcttatcgtcgagcagaggaacgtactcatacaccttaacagtcttaccgtagttcttcggcatgttaatggtgttagccagtggcatgaagtactggtctttacgagactgaataatagctttcttcagccagtaaaaggtattcatctgatcggaaccagcaccatcaatgctagatttctgaccgtcaattggagcgttatagtttaacatatcgtattattcctgtttaaagactacccggtactgggagtttagcgaaatcttcatcactcatagcgagtgggtttacaataggtgttgctttgcgtgtagcagcccgattaagggaagctgctttagcttgctcactgttagccagagtctgcttaggttgtgctacacgcactaccggctgaactgctggtttaactgcttgtaccggctcaggcttagctacttggttaaatgctccctgttgtgcaaggaggttgccaacgtagttataagcctgaatgaacggagtacctaccggaatctgacctaacatctgaagacggttcacttcatttgcaatggtgtcataaataccattctcacgttgttcgtgaatcgtatggagtaagccacgattctgataaagagcatctttactggcagcatcccatgtcgagccaataacacctaatgtagcttgtccttcttgagtagactttaagtcgtcaatttcggttgcaaaatctgcttcggtgtcggtaacacggtgattgccaccctggtagttaatttcctcatctgggttaaaatccagagggtctgtaccagagtctttgagcaacttcttaatggcctcaggattcttcttatccaggtcaatcaggaaagagagtttgtcctcatccattaaaccgttgttctgtaacatcagcattaccttacggtacggctgaagttcttgcatcttacgagtatagttagcacccatctgcatcaggctaatggcctcctccggtgaacggggagtaatcattttgccgttagctttaaaaggagccatcaacttctcataaccttccttatagttgaagtcagcaggcagaccttcagactgtttgccttcttctttctgttcctggccgggttcagtagtagaaggttcagctttagtaatcggcttaccgttactatcaacttctgtgtcaacaactttatcatcaactttatcagaagttaaagaatttgctgcatcttcttcaactggttcggtttcaggggaggtttcttcggttggtaggtcttcaacagcagaggtgtcaacttcttcatcaggagtctgtacgccgttggtttctgggttgttctgagtggaagtatcttcctcagcgataactgctggggcttccatattcagaatctcatcatccgacattgcgagaatgtcggaagctgtggttgcagcttccgtagtcataggaaatatctccggttaattattcatcttcaggttcagcacgaactgcatcgagttcttcttctacctgaagaataacgtcagcttcgttttcgcccatacgaatggcgaggtcgagccaacgacgtaagtgaccagcagcttgagccatgttaagtgcatctgcacggttatttggttcaagcagtgggtcaccagactcctgcacgtaacgtgcacaatcttctacacagaactggcgaagaattactttacggaacagtggattctccagaagtttacgtacatcttctgcgtgtgcaactgcacctttagcagcttccagtcgatgttccagtccagcgattgttgattctttactcatgtgaaggtctgccttacaagttcatgccaagagccgatgctgggtcttggctagggtcatagaattgggaactaagtgaataagctgggtcttgttgtgcagctaagtcacgttctggtatagagttcccgttagtcaaagcgttatatccaacagcagcagatatgttgggggtagtttcaccttctttagtaggtgttgtcaacgccttagttatctgaaggttttggtttccttgggattgtgctttttgtttttccatatcacgagcatgtttagtaccagattcctgttccagataatccaggtctttaaggtcaccactagaagcagcttctttagctttagcattattgagtgcaatcttactttgtaactcttcattctcaagctgtgctttctgaattgccaattgcttaagctgttcttccatagggtctggttgtggttgccaagtacgtaactcatgagcaaggtctggcatacgtttaagttctgcaatcttagctacaagagataacgtaatagactggtcaactgtgttgcctagtgtttgaaccatgaagcccaaatcctgggacttctggttatcaatttcagcagtgttaatatcaacctcaatgtcgaagttacctttaaggtcttcacggttaatctctacatactgttcgttagtaatacgtactacttccttctctgataagaacacagcattcattgcacaaatcttagtaccaatgtctgccatacccttagctaatcgacgaaggattgccatctcacgtttagatgctgcatcaagtgcaccacgaatgccagcagcaacatctccgtaagctgaaccagttacgccgccagagaatgctttaacacctgttagagcttctgcttcctggttttgcatctgagtcattactattgcagactgaggcaactcagggaacttgtgttccataatagactggctaggatttccctgcatcggattatattcatagtcttgcccatcatcatatcgacgacggttcagagtatctaacatccctttaggataaccacgctgaccatttgcacttcggcctaacaggtcaatcattccacgaatagttgcaccaaggattgcttggttatctcccaacagttcagcatcagcttcaccgtaaagttcacgtttacggggcatgtagggaacaactactaatggtaacttgccatcagggaatgggttcttctccatacgaataagagtagaaccaatccaggtagcaacaattggttccagtgaaccatcatcattaatgtcatagaatccccagtactcataagcaactactttcttacgaagtgcatccttaaactggaagtcaccaggagttttgctttcatggtctgggtcagtaatgggactggaactctcccagtcaatcttatccagattgtgataacggtctttgtttttcataaggtctgctttgcaagtctcaaaggagataactgcatacagagccttatccaaatcaccattacagcttgggtcaataactacgttattagggttaagcatctcaacggtaggtctgttaaccagtgctttttctacttctacttcagtgacccctgtctgaattgcataagtagcttctccagtttcattgaagtagttaacagcttctttgatatcttctggcattgtttcgtcatactcacggggattctctgcctgaagctgcaaagcctgttggagaacatctgcttgttcctggttctcaattggatacaactggaagactggagtttctgttttaatcttaatagtcttacgttcccaaccgatacgagcaataccagtaccgtcatctacgacactatgcacgtaatcatctaccagttttactttattaagctgagtacggaattggtagttaagaactagctcattctggcgtgcagctaactcatcttcaaaagtaaccggagttaccttaaatagtttgttagacgagaggaatggttcagacaatggagcataacgccactctgcctgacggcgaaccagtctaggctggacttgcgagcgtcccttaacctttgggggtttagccttaccctttacttccattaaatcattccactcacgaatctgtgccatgattgcatcgtgagcaggtttagcagattccaaatcacccttcagtaattggatacttggttccttcttccagtccgttaacttctctgattgagccgggtctggtaaaggcttaaaagtgtcttggtgttccatagttattcctgttcaaaaagtttacggtcagcctgaatctgtttacccaactcaattagttggctgtcacggagtctaacagttgcccggagttcttcaaccaaacgtctgccttcttcaagactattgtcgagtctggctgcatggcttgcaagacttctgcactcaagggttccggcttcggcttgacgtttatataccgatgctcgtctttcagactgttgcatccggctgtcgtaatcactgctaacgcgagcaagctcgcttgcgtaattactctcagccgtctgcaaccgggaagtgagtaacccgacttcataactatggtttctttggagagcattgtatttgtcctgtaatttttgcgttgccttttggtcttcgaccttttgggcatcccatttcttttgaacagtagactgcccattggaattgccccaaaagtaaatggtggccccaaggaccaccaccagaagataaggccaacctttagagattagcatcttcattacatgcctccagtggcacattgcctattcggttagctacccaaccatacgtaaagtctggcatgtttaatgaggtatagtggttcagttgtttagcatcaagcagcttaatcattacctgacatgctgcaactttgccccgttttttctgtaatgctttatatgcattaacagtacttgtaccgactttaccatcaacctgtattttagggtagtctttgccattacgtgacatttcattaagagacatctgcaaccacttagcaggacgggttacaccagtattaacaccagcatctactagcttatgcgttacagcaggagatatatcagcgaaggctacgaagttaggtttaagtacatagtcatcaatgtatatctcagcagccatctctttagataaacccttcatagaaccatcccaaccatactcagtagccagaacttctttatgagtcttagctactgattgggtaataccatgattagtttccccacctgggtcacgaggattgtttacataacctccttccatatagaacactgcccccagaatagcagcgataacccctcccactgcaccaccttttgcagcaagtttctgtttagctttcatgtgaatcttcctttggtcggaatcgtattaatctgcctatgatgtttaaggcaaacagtgcgattgcaatattggaaccatggggaatatcttccaagatgtgacgaggtaatcctgtcaccattggttggatgatatctacagcagagaatagaattaaaccaaacgtactaatttgaatggatgcccatttccagcatcttttccagttaggtactaactctacttttctttttagcctgcgaaccatgcgaatatctcccgtcttgcagcagccaatacaccaataattgcacctgctccagcccatacccacttaccaaaaattccagcaccaacaactttatgcttaatggtgatgaactcttcaatagtaggttcattcttagctaagctatcctccacattttttagtctattgcctatgtcattgattgaatcccgtaattctcccagagtttcctccagtttctcacggtcctgtctgtctctcgtctgattctcaaacagagtcttcaatcgttcctccagtctgactagaagcagttcgcccgattcattcataatattaccgtagttgtaaagttaagaaccccaatagggtcgtatcataagatgactcttagataatacttagtatgatgggatacatccagacatagtgtctggtatcaactgcgaggtaactatgtctattaaagatattttccaaagtggtaaggatgttgtgtgcaaaatgaaggggggattgttggtcgtgggaagttatggggaacgaatagtttctgctaataacatctcagagatccccccagaactactacctttcccaccaacagagttagaagacacattccttctggacttgtatacatggaccgggagccaggcagtaaatgaccaatcctggttcaattacttttcattaccagggataactaaatcacctggaggtacagcagcactaacaattgaagaaggaaatcttaagttccccattagaaccaggaatacccaggtaatgttcagtgttcgtatatcaggaattattgcaggtggtgcaggtacagcaagggaatggagaacacaaacaagacgaaccaatggaattacgatagtaggttcagatgctagtgttaaagtacagggtacagacattgctaacagagataacgtactggctacttacacacttggttcaactgaccctttcatggtagacggtattcagttaggtatgtttaatatctcaggacaagtaattaccctaacagcagtatcaattagggcaatgcaaacagtaaactctatataagaaatattattaatagataaaaacaaaccccgcctgagcggggttttatacctagataagtaatagcctggtagtacgtaggctactgttaaccaactctactgatctaaccgtaccagtattactcacttagacataacagctaatgcttcctgcatacgcttaatagtacgccgcatcaacgcagcctctaatatcagtacttcctcgtaacgaataccgtagcgggaacctgctggtgtaatcagtttacgagagccattggcatcttcctcgtatacatcatcccaactgtcgaagcacaggaagccatagcgatgtgcatctataccgtgacgttcgaatgcctccttagctcgctgagcgatgatgccgaagtgccatctagctgagtctgcacccttctcctcaattcggtccaagtactgaaattgcacaaagtcaacttcagaccaagcatccagtaaagcatctgagataataagaggctctgttttatccctagcatctgagataacagtgaatgctgattgagtaaaaccgccagaccatgctcgacttgcggaacctaatgcgtatgtatcagtactatctggggtcattgcattagaacctaactgcaaataacctgtgctactggtaggaagacgcacgttaccgttggtgagtgatactgtccgagaagtaccatcagaagtaaataggcgaacttgagaagaagtacccccacctacagctaatgacacagcaccatccccaagcattctgtacttatcagccgaggtaagaacgcctgacggaagtgacatggacttaatccgccattcgaacctaccggacatactgcctatgtactgtcctaatgcaggagcgtgcactacgttactattactagtgccgtcaatagtaactgcaccttcaatagtaccagtagcactgagaaggtcgtttctccttcccggatgctttacctctacgaagttacgggtagaacctgattcgaaagtaataacacctgtagcactgtagctaggaaatacagacgcatagttgttattagctgtatctataaagcgcgcaattgtagcagtttgagcttgccctaaagagttagtaccatcacatcctgacataagcacattgcttattacgttatcagagccttctactgtaacaccgtgagcctgactagcgtcagagattgagaaatctacaagcacatctgagattaagttggtactacctttgcctgcaacaaccgctgcatatttaggattattagccactaccccattgataaggttgttagagggagctattgacccttctgtaccgttgtaagttacatgctggcagtctgcccctataacattgctgactatgttataactggctgtacctttcagttctacagccccgaactgagggtagttcttagcaatgacgttatttatgagggagttaaccgaggaatcagcaagtatgcatccagccgccttattagtagcatagccggagtagctacctcgaatgcctttaatcataagcccatcagagggtgcatcattagggtatgtgattaaactgaaaccagcgcccttaacgtttgagaaattaacatcacttatagtaacatcactgccaccagcaagagatacctgctgcccttgagtggtatcggtcgccttattactttctaccgtaatattacttaagcgacctgagcgtagattgttaaatactaagtagttacctgtacttgaacggtgacttagtacaccactgcctctaccgtctaagttacagtaattactattaataccagaactagagaatacaccgtctgatgctacgacagctttttgagaatttagtgaagcagctatattctccgtactatctgttacaccatcccctttagcaccccagcctcgaacatcaccctcatcacgccatcttgccatctgcaattcagggtaactggacgcaccatccgggtctgaaatctggctgcgcagggctgcatcaccgacgctcagccactttcctgtaccaatatcaggaacagacccagcatctacaacctttggcagtgcgccatcccatcgatacaacccaccctggtattcaagacattcattctttactttaatctcataacccaaagagaaggacccagggactgttataaactctcctcgtgaaacagctagtgcacccaggtcaacattaccagtagagtgaactaacacaccggcagtattaaggcttacagcagtaacccctgaaccaaggtctgcaggtaatgagtaagctcgctgggtagtcttatcataaatgaccttgtattcccctaagtctacacctacagcaaagtaaacaacctcattctgcttaacaccaaacttacgggcaatggcttgtttgttggtaagaataccagtggagcctttaccaccttgtgagaacatttcgttcataagaacctctttgtttttctggttaatggcgtccttgccgaatatatccttatgtacacattggaagattatttaaatttttccaattgccgacgaagaaatgcacacttaagtacgggagatttctcataactaataccgtatccacccctccaccaacttaatggcaaaatggttttgtttattacttctgttcaagagcagaaagtctggcttcgattctttccagttttcttctctgataagcggcttcagcaaagaaaattccgtcaggccgaacaccccactcctcaccctcttcatgaataaccacctcggtgtatacaggttcttccgtagtagtgacattaccctcctcgtcagtgtgttcaacgatttcattgtgtgaaaataccgtatcggtcatccgtggatacttgtcatagcacagaacagcataaacgacaattcgtactgttttcatccatcagaccatgtgcaatgaatacatcacgaatttgttgagcaataaccccgaagtgaatacgagcatcattgcctttcagttgaacagcatctaaccactggtacatgatgtagtgaacgtcaccccaggcatccaggaaagcatcatcaaaaactaccggctctgttttcttctctccgttagaagtaacaatagggttacttccgaggtatgcagtggtgaaacggttacttggtccaccaagcgcaatgacgttatcgttataaggcttaacatcagcaccctgaaacagatgttcatttccgttgtaaactatcctgcgagaagctgtgttgctcgcaccgtaaagcgtaatctgtgcaccagtagaagaactggttccgtctcccccgcaaaatatgatgcgctgccctgctgggttattagtcggtacagatttcccgataaacccatactcaccttccattaaaacttcagagcgaatgttactactggtgctggctctaagggtcacatgacctaaacccaaatctcctgtaaattccattggagcaggaacagtgcgaatcccatttgtatcaaaaaacacggggacagctctgtcaggtacagcaccatatctgaaatccctggaaacacgattgtctgaaccaatcttcattttgtagcaatacaaatctgatggatgaccatctgatttgaatgggtctttcgatgagttatctccatatgtccaggggttcagatggtcttccccaccgaacaagtaatagatataactatccttaacgaccactgagccaacaccaacgccagagttgacaatgccaccctgataaatctggtcagtgatatttacccattgagtattatccaggttccaggtgtctaggttcactcgcgtgtaaaacgttcgcgggtaagaactgaaatatcgctggtcgggtgcgtttgcttcccactcgttgtccgcacgttctgttccaaaaagaatgagttcgtttcctaccttagcgaatggcagggtggagtggtggacattattcgggaacctcaatgattgccaggatatacccaaatcgttactacgatgtagtgaactacccagacgatccgaccgagttccacgggttacaacataaagaacaccgtcaaaatatttaacacagggttctgccgcatctggctcatattcagcagggatacgtcgttttatataatgcccaggattgttaaatgcatccgggaaatacagcataccaacttcacgtggagcagcatcaccctggtgatatcccatcataaatgaatcattattgatggcggtaaaactgtgaacctcggtaaccatgggaatcagtccaaggttggttttacgccaaggtgactggtggaacgatgtccccatatgccagactttggtagagttattttggtcagattcctgttgatttggcgtggtgacagtaaatgtgttgcggtcaataactgaagttacagtcatattccccgaaacaccagtcaccccagagttcgagaagttaacaaaatctccggcaaacaatccatggtcaggaatagtaattacagccacaggctgattagcggcttttgtgataccacctgtcggatggtaattacgggacataggacggtcccatatctcacaggtcaccagtgcgttagatgctaaagtacgtgtctcaatcatcgcaaagagacgattacgcatcacccccatactcatacagtggtagttaactgtcgggtaatcaggatgtaggtcggttaaccattccggcgttgtccaggtctgtccgtcatcccctgaacgaacccaggatacatgcagcctgctgaccccatgtctatcactagccatgaacgggcagtaaataacatcatcgtaaacgaacgctttatcctgtggccacgcattgtaataaggggtgtccgttattttgaaaagctcgccctgaacaaattcttcagaggcataataaagcggctgaccaggaatacgctcataaacaaaacgagtgttgacgaatcgactaatatcaggcaaggatgtgaccttatatgtcttcccattgccattaatcttttgtccaactggtgtgtcgtttaatacgttcgttaatgctactgtatcatcatgcacagcgtcccctttaacaccccaaccacggacatctccctgattacgccatagggtattttggtcagtttcttttttggttagtaactcaacctgaatgttacctggagtatatgtaaggatattaccaactacgctggatatatacacattagttggtaattctggaataacgtaaatctgctgattatcgggattataaataacttttttgttatttaaggattgtactgtattagtactgagaataacctcagaatcttttacattagccgcacgagccacttcctgtagagtacgatctgttgcttccaatactcgtgcttcaccaccaatctgtactatcaaacgatcattggttgtcagtggttcggtaagaaaaatacgttggttatctgggtcagcagtataagactcagtagttaatcctttatacaaacgaagaccattcttatacacagccggaatagactggaaggtatacggaatagcaataacctgctcaccccctacagcagcaccattgttgtacaaccaattgatctgaatccagtcattaatgttaggattatccggtacagcaggaacaccagtcagaaggaatactacttcatctccttcctctaaaggttgagccagagttacggacaggctgtctacgttgaactcaaatccacgacctacatactgcatgtcgccattaacaataatgaaaggtacacccaccgtaccatctggtacgttgattgtggtttccccaccagtagcagaaccattactgtatacccaaggaatataagcaccttcactggaagaagtaccaccaccattggaaccagaagtagcaacagtaatccacgaaccagttgcttctgagtcatctgggatgatgccagtacgatcaccttctacgtacaagtaatcagttacctgccggtcacctgcacgggagaaaccgtagatacgggaatatttaacctgcgtggataatgccttcaattcctcttcagagtttacaccgatgaccatcccatactggttcaggaaatcatacaggagtttaagattacccaggttgcagtacacagtacgaaccacatggtaagcattaccaagcagtgcatccaccatttggtcattggaactgctatgacaatatggattggtccaatcctgatttgcatcaaagggggtatgtgcgttcatcgccatcctcgttgttcaaatttagtttcggtaattgaaatacttccattagccaggtcgtaatcaacaacctcaccacagatgctttcatatgtttgcagatgctctgctgctttagcgttagcttccggagtattcaaaccggtgtggtaacgataacccacccagttatgaagtgccgtcattagcgtatcagctaaatcaacttcctgttcttcatcacccgtaagcactgggtgcttggcttgatacattacgttaagtgcctcaaagtgtcgaggacgcatacactgaatagtatcaggccgtggagtgaagatagcacgagggtccgaatcatcgttcagtctacgtcggttccctgagttatcaaatacatttaagattttaataacatcatcctggaaaggtttcatgaacccatccatgatgtatggatactgaacctcaagagtgggcttagtaaatctggagtaagcatatctggattgaagaggataatcggtacgcccttctttcatctccacaatacaactattagttctgagagggaaacgactatgcagtcgaaccaatccttcattaatagctgccagtatctcaggcttactatcaggctcaatacacaatctgtcatccgtgactgcaccagtacccttcaaggtacttagtgccaagccacggtatacttccgataatttttgcatggttcctcacacaatatatgaacgtagggggttaacactatcttcttcttcatcgtcccacatcgggtcacccttgttatccaccatagtcatacctgcctgtggtttccagggattgagataacccagcatagagatagtatcaatacagtcatccttacctttgattccattaatggtagctaatttaatctggcccatgaacaaacccataatagttgaatctctcaactcttccgggaagtacatcttaccagctttgaaccatggaactacctggttaaagcgtgacagcttagaggttacaggacgtatgcctggcttaccaccttcagaggatgcaaagttaaagaagacattacggttaatcatttctttttgaaggagtgagatgaatccaccttgttgacctgtggtttcgaccccaacattttgtggttggtattcctgaaccagacggaataagtcatcaaagtttttatccataagctgacgattagccacaccatcaacccagaaccaatctccattagaactataagcccaaactgaaatgacactgtagtcactggtctgtttctccgaagtagcaaagtcagttgtaatgtaatagttgtagcaggacttcatccttaatagttgttgtctgctataccacctaatttcactatcctgaaccagtctctcatcttcagaactaatacgaagcataagttcctgatagaagccagccaacttaccagtcttaactgccatatcgtattgagctttgatgtagtcatatgagaaacggtcatcccatgcaccctgaaattcttccctgctacaggggaacttctcgcatacaggccatacgttgacatcccatgcaccagactcaactgcttcaatgataatgtcttccttattaaagggagtaccattgaaaattactttacgacgggttgggtcaagagcatggttcacacctttatagacggtatccttaatagcttccatgcttgtcttggagttagcatcaccatcgctaatcaagtcatccagtacacagagtgttggacgtttaccatatatcttcgtaccacgaagacctgtcttagcaccaaacaacttaacaccaagtcgatgtccttctacattacggaactccagaaggttatctgtaaatgtagcctcaggtatccattgctgaaggaactcactattcttgtaacggaactcaatgttcttacgtgcagacttagcaccgttatccattgagtcagatacgtaaatcattccttctaccttacccaggcttggtaaatgaccaaacactgccaggaacaaagtaaagtactccatgaatacagcagttttacctgcaccacggaaacacaggttaactacatactggttcggactaatcatcttatccagcatcttcaagtgaactggaggtgttttgttagattcaccctccttaccattaaccaacttaataaagttggcaaaggtaagagcaaactgactaggaacatagttagaagaattaaggtgggagtaatccacctggtctagccattcatctagttcctgtttaattaattcagacatttgtaatgtcctcatctgcacgtactagtttagaaccagcaacctctttggtaggtacaccactattgattgcattgatttgctgttcagctaatgcagcaagtgttgccttgaggtcagttaacccggagttctctcttaagtccagattgatattcgttacctggtctttcggtttagccaagtgagtaaggatagagttagctgcatcacatcttactttctcacttgctgctgtggtcattagttcaacctgaacgttgatagccttttgataattgtcctggttcacaatccacactggaaccaaactttgttccatgatgaggttaaccaatttacccctatggtaagcagatacataagcactgatatctttctcactggttcctcgtgctacaagttctgcttgtcggttagggaatgtcttaaagtaggcttccttatttgagtagcccatgtgtttgtaagtcacatactgaactgcattcatgtagtcctgtgtcttaaacttaccttccttcataactccagagtaagagatgaagttttcacggaatgcttcagcaaccagttggtcttgggtaatgttgttaattgtgtccaccaactcctgggttacactgttcttgaagttagcaggtagggcattaacaatctgctgcttagttagttcactcatacttatctcgctacaaagttatgtctattaaagaagattcttttcttggggtgagttaccccttgaagaaaccataccatacagttacactttagtcatgatatagaaaaagttcatgatactaaatagtatgtaatgttccgatgaccctattcctaaaaggagtaacatttgagaatctatatgagagtccacgactccaaagatgaatacaaagaactagaccataccaaggctggtattctttcagatgatattatcattacacatgatgaagattcctaccatgaattagctgggatgatgctattagagaatcgtccaggcattaagatcttagaaccaagagaaacttactctttagaaaagagactttcagctcttgtgttcttcacaaaattacctcatagtgtctccgtcaggcgaagcaaagatagtgttcggatgatggtgacgatgtgattagtcatgccgcctagtagacagtggcggtactcgtaaagagttaataacttctacagtcagggttacccggctcctttcctacctagtaggctaacgatacacatgtatctagggtgatgaactgacccgtgattgaaaacggtaaggggtagagtcgagaggctctaccccatttctttttcaggaggtatgcaaatatgagcatctacgcttttgatattgatattactgggatacttcgtaatcaagaaccttattaccttggggaaccagaagtagtaagtaagttcattaccccatggcaaacagtattcttacctgactgtgaagagtcacacgaggttattggttctcttttcctatccaacctgcaactcaatactaagatactcactgaaccaaaggtgtatgacctctccttttacagcgactttagtatgattttccctggtgttaggttctataaaatacctggttgggaattgatagctgaccataatgtctttaataaaacactttccatttacttcagacctattcctaaaggaaggaaaattaatcatgaaattcataatgaccatccccagttttgctgaaagagaatctatgtatacaactgacttctctttagaagaagtaatgaacagcaacccccagcaagtaatcctggttcctaccttagaggactaccatgaagtaaggggacagctattcttagcaggtaatgatcgtaaggttgtatgtattattccaccctctgtctataccaactacagtgcaggtgaccctatcccatatatgttggtatctaatgactaccaatgggatagtcggtatgtaaatgatgaatactgttactactatataaggaagtaagatatgcatctgtattgccttattagctttgctactacttgctatttgtctccatatacattggataatatcctggcaggtaaggggagagttaccaccatcctgtatgagccaagtgaagatgcagatgtgctcataggtacttgcttaatgttggggcaacctatccaattcattaagatagtagattccgtagaaataccggaacacaccagtgtgtacatattgtcagagagtgaacctatggtagtaactacccttactggtagacttattaccctctatccttctacctcatatttatctagcgacgagagtctctaatgaaactaaacacatcaccctacccggtacagttagaagtagtattcgaccaggataccttcattaaaaagtataagaaacttaaagggcatgagccagacttggatggttgtaaggggtatacttcttattctggcaatcgagtattgattggtatctttagggaacctttacatacactcatccacgaactcaaccatttctgtttgtgggcgtttgactacataggtatgcctataaactctgccaatagtgaagcatattgctattactatgaccacatcctctcccagattccttcctcctatttaactgcttataaggattagcatgagattatatttcctatcagatatgggaaggttacatgtaggagagggtatactatggaattggatatgtaacaatattcccaatgtacctgtatatgttcactccgatatagactatcactggttaagaggcgagtgcttacttagaaatatgatagttaacttcataaaactagaaccatgggatagggtatccgatgtatctggcccatgctacttcttagcagttaatgggcatagagcagagaagatgttatatagaactaaatagagggtagatagataccttctcataatatttataaataaggcagaaccggtgacaagagtacaatacctatgaatcctatagcgaaggcacaggcaataaagtgaagccagttctcagggtctgtaggattgtaattaccccaaccatctttcatgttagtaccccaaagttatctgcttatagagatagtgcctataatatttttgcatgtcaaaattgtgatagctatatacagcagcagtgttg
